United States Patent 12,491,220 (COMPOSITIONS CONTAINING INDOLE-DERIVED METABOLITES AND METHODS OF USE THEREOF) - sequence listing, part 10

SEQ ID NO: 13 - DNA, 3446695 bp, unidentified (residues 1-1,723,348 of 3,446,695)
  source 1..3446695: mol_type = genomic DNA; note = Weizmannia coagulans
atggaacttagaaatgcagtgcctgtcaaaaaagcaaggaagaagacgaaggcaaggtatattatattattcgttttatttttaagtactgcactaaactacctcgatagaactaatatttctgttgcagcaccactaatgaaaggtgatcttcacttaaatcctgtagctttagggttggttttttccgcttttggatggacttatgccataatgcaaatacctgggggttggttattagataagtttggcccccgccgtttatatggagttgcattgggtgtttggtctgcatttactttcttccaggcttttgcaaaaggatttacctcactttttggtttaagactgggactggggctttctgaagcacctgcatttcctacaaacaaccgattggtttccacctggtttccaaaacaagagcgggcctttgctacaggtttctatacagctggagaatatgttgggctagcttttttaacaccggtccttgcttggattgtttctgattttagctggcaggccatttttattgtcacaggggtacttggtttcctatttattccaatttggtttaaatttgtacatgagcctaaagacagtccttatgtaaacgaagaagaactcgattatatcgctaaaggtgacggcattacagagaatacggaagaaaagaaaaaattaacgtggtcacaaataagcatactttttaagaaacgaacactttggggaatttatattggccaatttggagtaacaacaacgttatggttctttttaacttggtttcctacttatctagtaaatgaaaaacatatgacaattatacatgctggcttttatgcaatggttccgtatattgctgctttttgtggtgtgttatttggtggagcgctttccgattggttcatccgccgtggtttttctaccagttttagcaggaaaacgccagttattattggtctcctcctagcatgtacaattgtattggcaaactatacatcatccattggtctagttattacaattatgtctgtggctttttttgcacaaggaatgtcggggatttcatggacactaattggggacgttgcaccaaaggaactaatgggactagctggtggaatatttaattttgcaggaaacctttcaggcattgttacacctattgtaattggtatgattattggtgaaagtcaacattttggaggagctctcatttttgtcagtgctgttgcattgatcggagcactatcatatttattcttgataggtaaagttgaaagaattgagatagaatcttaaaatttaattttcaaccttattcttcatttttacagtgaagttacagttttacatgttaacatgggtattcacggaaaaccaagtgatccgcaacggcttgaaatgttgataaatcaacatttatagagggaggaatcagagtggaaaagagtttagaaaaagccagtttaacagtggaacaagtaaagaaacttttcatttatacaggagaaaaagtccaggaaaacaagcaactactcacgaaaattgatggcgctattggagacggggatcacggaattggcatgtctctaggttttaagaaagcaaatgaaaaattaagggaaacagaatttacaaccgttaatgaaatatttaaaacaataggagtgtccatgatctcctctatgggcggcgcatccggcgtcattttcggaacgttgtttacaggcgggctgaaaggtcttgaccctcaagaaacattggattcgaatttattggcaaatattctggagaatgcattaaacgctattaaacaacgcggaaaggcggacttgggagataagacaatgatcgatgcccttgaaccagcagttcttgctttaaaacaaaaagctgaaaatgatgctggtttgcttgcctgtctgaaagcagcagaggaagcagctgcccaaggcgtagaaaaaacgaaatcttatatagcaaaatttggaagggcaaagacgctcggagaaagagccattggccatcaggatgcaggagctacaacggtatggatcatttttaaatcaatgaaagaatacattgaaaatttatctgtataaccccgaatataattttggtatttcataagtagcaaaagcaaaagaagagaggaggaaaagatatggttgcaaaatttcatggtattattccgcccgtctcaattatttttgataaaaacggcaagtttgatcaaaaaggaatggcagttgtaattgactttttaattgattccggcgtgaacgggctttttttccttggaagcggtggggaatttacacagatgtcgacggaagagcgaatggaagttgcatcatttgcaacggagtatgtaaatggtagagtgccggtactgattggtacaggaagtacgaacacgcgcgaatccattttattgagccagcatgcggaaaaagtcggtgctgatggagttgtcgtgattaacccttactattggcctttaaccgaagagaatttatatcggcattatcatgatattgcacaatccattgaaatctctgtattgctctacaattttccaacactatccggccaggatttaaatccggaatttgtactgaaactggtggaaaaccatcaaaatattgtcggaataaaagaaacggtggaagaggtttcccatattcgggatatgatttcaatcgttaaaaagaaacatccggactttgcggtcttttgcggtttcgatgatcacctgctacagacgcttacaattggcggagacggagcgatttgtgcaagtgtcaattttgcgcctgagttggcaattgggatttaccatgcctttcaggaaaagcaatatgacaaagccattgcattgcataaaaaactggcatttttgccggcgatatacaaacttgattccccgtttatcagtgttgtaaaagaagcaatgaaatataaaggattagatatttccagctatgttcttccgccttcccgcccgcttgatgagaagaaaaaagaggcgttgaaacagattttatcggaagctggtttattagaagaaacacttcaataacaaaaatgcggcacaggaaaaatcgcttcaggccgggatgtccagccttcctgtgccctttgctttgcgatgtagaagaatccggataggcgaaaaatcaaatgatcctgcttccattgcagctggcgcccgtatcggtacggaacagggagcagatattattaaaatgagattaaccagaaaaccggaagatatacaggtgattcaatcagctaaaaagccggtaatcgcacttgggggtccaaaagcagacgatatgctggagtattttatgttcatccaacattgtatagaggttggggctaaaggtgttgcgattggaagaaatattgttcaaaacgaggatccggctgacttcgttgcggggctaaacaaaatcatccatctcaatggaacagcagaggaagcctatcaagtttatatcaatcactctctgacttgacaattttgacaaaaggtaaacaaatccttataatcagaataaaagaaaatgaaataaaatgataataaaagaaaatcggaggcgtttatatgaaaaaagtaatcaacgatcctgccaatgttgttgaagaaacaatcgaagggttccttgcagcatataaagatcaattccgaaaagttgatgatgtcaatggtgttgtacggagggatcacaaggaaaaggtagccgttgttactggagggggaagcggacatgaaccattatttatcggtttacttggagaaggtcttgctgacggcgtaacattgggaaatgtgtttgctgctccgaatccatataacattcaggaagttgcaaaagctgcagataaaggcaaaggcgttctttttgtatacggcaattactccggagatatcttgaacttcgatatggcaactgaacttttggaattggaagggattgaatgccggacagtacgggttacagatgatgtggcttccgctcctgcagatagaaaaacggatcgccggggcattgcgggtgacgtttttgtggtaaaaattgccggcgccgcttcagaaacaggtttatctttggaagaagtaaccaggattacacaaaaagcaaatgaccacaccttttcaattggtgtaggattgacgccgggatccattccgggtgcagctgaaccgccatatacactcggagatgacgaaatggaagtgggtcttgggattcatggagaaccaggcgtaaaaagaaccaaattgctgcctgctgatgaactgacggacaacttaatggatacactgttgaaagaaagcggtatcactgcaggagatgaagtttgtgtattggtaaacggtttgggttccaccacattaatggaattattcattgtcaatcggagagtcaccaaaatccttgaggaaaaagggattcgagcatatgacatcgatgtaaacagctactgtacaacacaggaaatgggtggattttccataactttgttgaaattagatgatgagttaaaggcatattacgatgcaccggctatctcaccttattataaaaaattggagaaaaaacctgtaaaagcgacccaataatcagtgagcctggggggacggaatttgaaaagaatttggattggtaccaattggaaaatgacaaagacaatagaagaaggcatctcttatacaaaagagctgaaacgtatctctgaaatgatttctgacaatattgagttatttattatccctccttacacgtctttggttacaataaaaggcgtgataagggattcccgcatacaattgggcgctcaaaatatgcattgggaagacagtggtgcatttaccggtgaaatttccccgaaaatgctggatgaaatcggcattaatctgattgagctgggacattctgaacgcagacaatattttaatgaaaaagatgaggatttaaacaaaaaagtacatgccgcattaaaatatcattttcggccgttaatctgtatcggagaaaatcggaaacaaaaagatcagggtatctccaaagaagtgctggcctcacaaataaaagtttgcttgcgaaacgttccggaagaacaggcattaaatgtaatgattgcatatgaaccggtttgggcaataggagagaatggagtaccagcggatgctgggtatgttagagaagtgcatgcttttctgagagatacgttaaatcaactttatccttctgtaggaaaagaaattccaattttgtacggaggaagcgtcaacaaagataattttcttcaatatattgatgtagagcatgtaaatggattatttattggcagggcagcttgggatatagaaagtttcgagtacatcctaaaatctcttgatacacatttatttaaaaaaatgacaagctgaaaatagaggatcgttatcattctttatgtacacccggtaaataatcccatctgtaaacagatgggattattccactttacaagaaaaagtgcagataaagcatatagcgaaaatgagaaatttcccttttttatcgatttttatcggttcctatgataaagtctaataagaaaaataaataaaagcatgtaaaacaccccgatttatatatctatattgtctcaacttttatgtcactgaagctagaggagaggatgcctttatgtttgctgatcaacgtagaaaagctattcaagatttattagcggagaaaggaacagtaactgttaatgagttgacagggttattaaacacctctgcagcaaccatccgttctgaccttaaccatatggagatgcaaggcctgttgatccgtacgcatggcggggcaataaaaaaagacagccaggaacctgacttgggtgaaaataattatgagattcgcgaaaaaaaattccgtgcagaaaaacaaagaattggaaaagctgcgctcaaatttttgcaagaaggccaatgtattcttcttgacgcaagttccacttgttttgagtttgcccgttatttaaaagatatcaacatgaaactaacggtcgttacaagcggtatctcgactgctgtcatgttaaaagaaaacccccacttaaccgttattattgttggtggaattgtgagaaattcctctaactccgttgaaggactattgggtgaagaactattgcgcaagattaatatcgacattttgtttacgtctgcctatgcttttaatatgaatgacggactaacagattttagctattatgaagtggaattgaaaaggaagatggttgcagcatcacataaggtcattgcactgctcgatcacagtaaaatagacaagagttcttttgctacatttgctcagccggaggaaatcgatatattgattactgacaaagaagtaactgaagaaatgaaccgcttttttaatcagcacggcatattatttgaagttgcaaaataatcccatgtatactgcatcccatatttatttcagtatttttatttaccactacaggcatggaagtaaaaatgctccttttacatatggcccggaagccactgtggatatgtcgtgttgtgatgacgctttttggatggcattaggaaagtggaaggaggggataatgaattgactattttcttatttacctttttcctcttccgtttgtgccggcagcatgtttatcagttgatctcaactcgtggggaagatacaattaaaattgtaaccgctttcaaaaataagtccataaacttcagcatggaaaaggggaatggcatgatcagcgaaaagtttctcaataccaggttgttggacatcgtgtttggaaaaacatactccggcacattgatcgtggatcacgaaggatatattcgttacataagccgcaatttttgcgattttttgaaagtggaacgaaacgaagtgattggcgaacacgtgacccatacaattgaaaatacaagaatgcatcttgtggtgaaaacgggaaaagccgaacttgcccagctgcagtttttaagaggcgaatatgtcatcgcaaaccgcattccgatcatagaagatggaaaaattctcggggctgtcgggattatcattttcagagatctatatgattggcaaaagctgaacacccatatccggcatatgctgtcgcaaagccggtttttacttgagaagcagccccgtgcagccggcgtaaaatatatgctcaacgatctgattggtagttctcggcaaatggcgctcctgaaagaaaaaatcaaaaaggtggcgcgcggagatatcaccgttttgattaccggagagagcggaaccggaaaggagctggttgctcatagcattcacagctctagcgaccggagcagtggtccgtttatcaaaatcaactgcggcgcgattcccgaacatctcatggaatccgagctgttcggatatgaagaaggatcgttcaccggtgcgaaaaaaggcggcaagcccggcaagttccaggcggcggaaggggggacgatttttctcgatgagatcggcgacatgccagtgatgatgcaggtaaaactattgcgcgtgctgcaggaaaaagaaatcgaaccggttggcgcggtccatccaaaaccgatcgatgtccgtatcatcgcggcaacaaaccaaccgcttaaagaactggtcgaacaaaaccgtttcagaaaagacttgtactatcgcatcaatgccatccagctggatatccctccgctccgcaccagggcggaagatatcccacttttggcgcggcatttcctaaagaaagcatcatccggtctcggcaaaagggtcaccggtttcagccctgaagccctctccgcgctcgaagggtacaattggccgggaaacatccgcgaactggaaaatgctgttcacgcagcggtctacatggcctcttcggatgcgatcgggttagaggacctgcctgaagcaatccgtgaacacttaaacagaaaaaaagaaagcagtttgaaagaaagaatggaggcagcggaaaaacaaatgattgaggaagcgctgcgggctgcctgttttgataaaaaacgtgcggcaaaagccctcgggattggccactccacgctttacgacaaaatgaaaaagcttcgtattgaggtaaaatgaacgcagtttttcacgtcaaacgatcaggatagatattgcttctatatagggcttgctgaataagcgaaattcctggatttggaaaggatgctgacagctttggcaaccatttaaacaaatccagggaaatgcttgcactcgaaagccgattcaatgtatggagaagatcaaatccccccttttcgcaaaagaattcttctatattttgagacagagcttgcagataaattgggcacaaactcagaatcggattcgttcagcaagccctatgtaaaatgaacttaagttttgacatcaagcccaaacatccacttgcatgagcactattttttaatcatccggaaatccagattggccttctgaaattccgaatctgtttttctgccataaagccgctgtttgcatcatagattggtaaagaacgttacggaaaacgggaaacgaagccgccttttccaacacgcacatgctgtttttcgcctctttcaagctggcatacttcttgctttttatagggcatcaaagtgttggaaagggggaacatggttgcacgttggctggatgatcaagaacattgcagaggatccggacccgcttgtttccggaaaaactgcggtgcaggaagaagccggaagagcatggactttcaaggaattgcacgcgatttccaatgcttatgcaaacaagcttacacagcttggcgttcggaaaggagaccgggtcggcattctgctctataactgccttgagtatttcggcctttattttgcggcggcgaaaatcggggcaattgcagtccgtttgaatttccgcttgtcaagccccgaactggtctattgcttaaacgactccggcacaaaaatattatgttttcacgcaggtcttgccgggcggattgagccgattcaacacgaggtgccagttgaacaatttatctgccttcaggaggaagcatcagtcgttccgggatgggcgcaaccgttttccgtgctcggggaagggcagcaggaagaccccgctgtgtcatccatccacttaaatgacccggtgatgctgatgtatacgtccgggacgacgggaaggccaaaaggtgcgatttggacgcataatacgacattctggttttcagccattcaagctttgaaatggggatttcaagcccgggaaacggccatgacaacggggccgctctaccatgtcggcgcaatggaagacattgctttgccggttctcatgcggggcggaactgtcatcattacaaaaagtaaaaacttcgagattcaaagagtcctgtctgtcatggaaaaggaaaaggtaacatgctgttttttatttccttttatgatttatgacatgctgcacttaccggatctggcacagtaccggctggaaacgctgaagacgatttacaccggcggggatccgctcatgccgtgggctttggaaagcatccgggcgcattttccgcacattggcgtcgtccaggtgtacggtttgacagaagggcagccgattgccgcttcactcgacccgcaggatgccgcaggaaaaggcagtacagtcggaaaaccgatgcctttgactgcgattcaaattgcagatgatgccggaaacccgcttcctgcaggagaagtgggcgaaattctcattaagagccctgctgtttcagaagggtattggaaaaaaccggaggcgaccatggagacgtttgcggatggctggtgcaaaacaggggatcttggcttttttgattcggaagggtttttaaccattgccggcaggaagaaagatatgatccggagcggcggagaaaatatttatcctgctgaaatagaagatgtgctttaccgccacgaagcggtaaaagaagtcactgtgatcggtatccccgatccgaagtacatggaaacggtttgcgccattattgtaaaaaaagatggcgcgcggctgacagaaaaagaagtggccgaattttgcaaacgccatcttgcaagctataaaaaaccgcgcaaggtcattttcgtgaaagaaattccgcgcacgccttccggaaaagtgcagaagttcaaacttcgcgaacagtttggcgcgggatgaagaagaggaatattttcccactgctataaaccgtttgcagagaccgggggagaaaataccaaccttttgattgcccggataaaaacgcccgggaattcaccacggaatgacaggtcgcgcccgtcagtctggcagaaaaagcggccatacaaacgccgttataaggttggtgcaacgtcaggcgtttgtatccccaaaaacacggataaaaacgcccgggaattcaccacgggattgacaggtcgcgcccgtcagtctggcagaaaaagtggccatacaaacgccgttataaggttggtgcaacgtcaggcgtttgtatccccaaaaacacggataaaaacgcccgggaattcaccacggaatgacaggtcgtgcccgtaagtctggcaaaaaaacagtcaaccaacgctgttctcaggttggtgcagcatcaggcgtttgtatcccaaaagcacggataaaaacgcccgggaattcaatgttggataaaagaaggtgttcgccactgtgccgggaagagtcgcattcaaacgctgtaaatcttttagtggacagaataggagaatggctttgataaaagcgagtgaatcgcgtatgcaggaattttcttaaaaagggaacttcgttttcccgaccgatcaccggaaaggagcatgtccatggaacaaagcggcattgccaaaagcaaactcgtttatccaagtgatgataaaatccgttcaaccgaaatcggttcaagcgaagcatttgaggaactgctgcgcctgtcgcaaacggatccggaagcattttgggggcgcgttgccaaaaagctcacctggtatgaaccgtggaaggaaacaatgacaggcagcctccccgggttccgcttttttgaaggcggtgtgagcaacccatgtgtgaacctgcttgaccgccatgtcgaaaacggtgccggcaaccggacggcgctcatatgggaaggggaaaacggcgattcgaagtttttcacttatcatatgctgcttgcagaagtaaaccggttcagcaatgtgttgcgcgggttcggcgtaaaaaaaggcgactgcgtggcgattttcctgccaaacttagcggaagcggtgattgctgtgctcgcatgcttccggattggcgcgatttacaatacgattttttccggatactcggaaaaatcgctgaaagaccggcttgtgaattttgaaccgaaagtcatcgtgacggccgatgcaaccgaacgaagagggaaaaagatttttcttaaggaaaaagtcgaccgtgttgttccggacattccgtctgtcaaagcggtcgttgttgtggaccggcttgggacggatgtcaatatgcaggcgggccgcgactgttggtggcatgaagaaacaaggaaggcaagcatccattgtgaaccggagcggctggaagcgaacgagtatggcattgtgttttacacaagcggcacgaccgggaaaccaaaaggcgttgtccattccggcatggcgtttgtcgtacaaaattacatttacgcaaagtaccatatggaccatcacgatgacgatgtgctctggtgctcggcggatatcggctggctcacgatgcatatttggggcattgccggcgcgctttcaaacggtgttacaaccatcttttacgaaggggcgattgattatccggaaaaagaccggttttaccagatcattgaaaagtaccgggtgaataaattgttcaccgctccaactgcattgaggatgttgaaaagcatgggggagcgtccgcttgaaaaatacgatttgtcatgccttgatgtcgtctcccttgtcggcgagccgtttgatgcggaaacatggcagtggacatatgaagtgctcggcagaaaaaagatttgcgtgaacaacacatgggggcagacggaaacagccggatcgccgcttgccggtgccgcctggctgacgccgatgaagccgggttctgcgggcaggccatttttaggcgctgtaatcggtgtcgtcgatcaggaaggaaatccggtaccacgggggacgctcggaaaccttgtcattcaaaagccgtttccgatgctgtgccgcacgctttggaaagagccggaacgctatcttggctcgtatttcagccaggtagacggctgctactatgcaagcgacctggcgatgatcgatgaggatggctacgtatgggtcaccggccgttcggatgatgcgttcaatgttgcagggcacaggctgagcacgatggaaatggaaagtgcggtgctcgaaaccccgggtgtatctgaaaccgctgtcattggcgtgccggatgaaatcaagggcgaggtgccggtctgctttgtgcgtttgagcgacgggacggaggaaagtgaagaactgaaagaagcgatcaaggcccggattgtcgatcaaatcgggaaaattgccgtgccgaaaacgattttgtttacggacacgttgcccaaaacagtgagcgggaaaattatgcgccggttgttaaaggaaattgtcgtaaacggggcggctacaggggatatgaccggtctcgaggaccccgcaaccattgcgcgcattgaacagctggtggccagtcgcagggcggaaagataaaaaggaaggttcgcccacaggtttgcgaaatcaatgtttttgacagggaaccggccgggccgccagtaaaaagaagggcgttactgtttgcccgccggtcccttgcagcgttttacagggaatcggaagcgaactggaaaaaggagcatgcggcggttgattttttcgcaatcccggcggctgcacctgaaaagtcagcaagaatgcaaaaaaaccggcgcaccggattatcctgcgccgcaaaaggaggaagcctatggatttcgaattgtctaaagaacagattatgctgcaggagatggttcgggactttgctgagaaggagatcgaaccgtatgcaagagaagtagacgaaaccgggaaaatgcggatggagacgtttcaaaagctcggcaatctcggccttttaggcatcccttttccggaaaaatacggcggagcaggcggggataccatctcttattgcatcgcggtcgaagaaatcggcaaggcatgcgggggaacagggctcagctatgccgcaaatacaagcctcggcgcaagcccgatctactatttcggcaccgaagaacagaagcagaagtggctcgttccgatggcaaaaggcgaagcgctcggcgcattcgggcttacggaaccaaacgccggatccgatgccggcggaacaaggacaaaagcggtgcttgacggcgatgaatgggtgatcaacggcgaaaaatgctggattacaaacgccgaatacgcccgccaagtgatcgtgacagccgtaaccggcaaaagggaaaacggtcgtaacatcatttccgccatcatcgtgccgaccgatgcaccgggcgtgacgattacaagcccgtatgaaaaaatgggcgttcgcggatccaacacgtgccagatcgtgctcgaaaacgtccgtgtcccgcgtgaaaacttgcttggcgacgaaaagaaaggattcagccagtttttgtacacgctggacggtggacgcatctccatcgccgcattatcggtcgggattgcccaagctgcattcgaaaaagcacttcgatatgcgaaagaacggatgcagttcggccaagcgatttcaaaattccaggcgatccagttcaaacttgccgatatggcgatggaaatcgatcttgctcgcaatgccgtgtacaaagcggcatggctaaaagatcagggaaaaccgtttagcaaagaagccgcttatgcaaaactgtttgcgtcggagatgggattccgcgtctgcaaccaggcgatccagatccacggcgggtccggttatatgcgcgagtacgacgtggagcgtcatcttcgcgacatcaaactgatggaaatcggcgaaggcacatccgaaatccagcggctggttattgcccgaaagcttggctgctaggcgaaaagatagaaaaccatccatgcgttccacaaattaaactgcttttgcatgatacacggatccgtttcaaagatttcaagctgtctttgcattttttaacatcgagaatcagcgatgagatgaaaatggctgtcggaatctcaaatgcgagtgaaatatgagaggccgggaaatcacaaaatttttgaagcaaattgagcagaaaggagcgttgccatttgttcaaaaaaattctgattgccaacaggggagagattgcgcggcgggtgatccggacgtgtaaaaagctcggtattaagtccgtagcggtgtattccgaggcggatgcgggggccctttttgtccgcgaggcggatgaagcatattgcatcggcaaatcgcctgtcaatcaaagctatttaaatgccgacgcgatcatccgggcggccaaagaaagcggggcggaagcggtccatccgggttacgggcttttgtccgagaatgcgccttttgcccggaaatgcattgaggcggggctcatttttatcgggccttctcctgcaatcattgctgcgatgggcagcaaaattgaagcgcgccgtaccatgaaagcagcaggcgtgccggtgattgaaggggtggatgatccgcttgaagatgaagaagcggcggtccgggcggctgaaaaaatcggttatcccgcaatgctgaaggcttcggcaggcggcggcggaatcgggatgcaggtggtccaaaccgaaaaagagctgcgcaaagcgtttgccggcaacaaaaaacgggcggaaatgtttttcggggacggcgcgatgttcattgaaaaatatattgaagaaccgcatcatgtagaaatccagattctggcagaccaatatggaaacgttgtgccgcttatggagagggaatgttcgatccagcgccgccaccagaaagttgtcgaagaagcgccatcgccttttatcagcgaagcgacccggcaaaagatgctggatgcggcagtaaaagcagcaacatccatcggctatataaatgccggcacgatggaaatgatcgtggaccggggccagaatttctattttcttgagatgaatacaagattgcaagtggaacatccggtgacggaagaaattaccgggctggacattgtggaagagcagttgaaaatcgcttcaggcgaacgcctcacgatcacgcgggagacgctcaagcggaacggccacgcgattgaagtgcgtatttatgctgaagatccgaagacgtttctgccatcgccgggcaaaattacagctttccggctgccggaaggggaaggcatccgcaacgagacggccgtggaagcgggttctgaagtgacccctttttacgacccgatgatcgcaaaactgattgcctggggcagctcgcgcgaagaagcttgcaaaaggatcagaaatgcgcttttaaactatcaagtggaagggattaaaacgaatattccgatgctgattgataccgtgcgccacgaacaatttttaaaagggtacacaaccacgcattttgtcaatgactttttaaaacaagcggagtcccgcaagtaggcgcaccggccggttaaaaggcgccaggggcccgaaaaggggggaatccgaaagaaagagggctgccatccctttcaatgatatgccggctttttaaaccaggcagagcccccgtatgaagatggccggatgaggggaggcagggagaacatgcaaaaaggtcccggccattacccgatttgacagtgactttctaaaacaggaggaaaagcagatggaaattacagcaagtatggcaggaagtgtctggaaagtgctcgtaaaggaaggcgaccaggtgaaggaaggcgacgatgtggtcgtccttgaatccatgaaaatggaaatcccgattgctgccgaggaagacggcacagtggtaaaaatccatgtccaggaaggcgaatttgtcaacgaatccgatgtgctggtggaactggagtagcgcaatttgctgaaggaggcggggatgtgaagctgcctgaaaaagtgaccgtgaaagaagtcgggccgcgcgacgggctacaaaatgaaaaagcggtcgtggcgacagcagaaaaagttgcatgggtgaacgcattgtcggatacgggcctgacgtacatcgaagcaggatcattcgtccggccggaatggatcccgcagcttgccgataccggagcggtgctggaaaaaatcagacggaagccgggcgtgacatatgccgcgctggtcccgaacgtgagggggcttgaacgggcattaaatgcaggtgtggatgaagtgagcgtcttcatgtcggcaagcgaaggacataacctccgcaacattaataaaacgattgcggaaacctatccggtcttggaaaaagtggtgaaggaagcgaaaaacgccgggaaatcggtaaggggatatatttcgacggtgattgcctgcccgtatgacggaccggtttccccaaagcaagtaaaagaagtggccggccgcttgtttgcgatgggcgtggatgaaatttctctcggggatacgatcggtgccggcgtgccgacggatgttgagcggttgctcggcgaactgctgaaggattttcatgcaaggcaactggcgatgcatttccacgatacaagagggacggcacttgcgaatgttgtcaagtcgctcgaaatggggattactgtttttgacagcgcagcaggtggcctgggcggctgcccgtatgcgaaaggggcagccggtaatgtcgccacggaagatttgctgtacctattcgcgcagatgggcattgagaccggcgttgatcttggccgcatcatccaggccgcacagcagattgaaaaaacgatcggaaggccgcttgcaagccaccagatggaaatttacaggatggcaggaggagcataacgggaacgttttgccggaaaaagcaaaaggcactggcgtggtgatccagaacagcccggaaccgcaaaacagattgcaaagccgatcggaagggcgcttgcaggcaaacaggcaggaggggaaaaagaacatgacaggaacagttttattggaaaaacaagatggcatcaccgtgatgacgttgaaccggccggaagctgcaaatgcattatccaaagaaatgctttcggatatgcatgaagctttatcggaagtaaaaaaagaccagagcacgcgcgttgtgatcctgaccggcgccggggaaaaagtgttttgcgccggagcggatttaaaagagcggaaaggcatgaacgaggaagaggtgctgcaggccgtacggaagatcggtgcggttgtaaatgaaacggccgcgctgccccagccggtaattgcggcgctaaacgggtcggcattcggcggtgggctggagctggcgctggcatgtgatcttcgcattggcgcccgcgaagcaaaatacgggcttaccgaaacgtcgctcgcgatcatcccgggggcgggtggcacacagcggctgccaagactcattggggttggtaaagcgaaagaactgatctatacggcgcgacggctgactgctgaagaagcagcggcaatcggcctgctcgaatacgctgtgccgcgtgcagcagtaatcgaaaaagcgtttgaactggcgggggaaatgcaaaaaaacggccccattgcacttagacaggcaaaaacggctatcgatcaagggacagagaccggcctttcagcagggctgaaaatcgaagaactcgcctacaacgcgctcattccgaccgaagacaggctcgagggcttgcgggcattcgcggaaaagcgcaccccggtgtataaagggaggtaatgcaatggactacgaaagcaaaaaagcagaaattttaaagggcggaaaggaaaaataccaccaaaaaaaccgcgaacagggcaaatggtttgtccgcgaacgcttgcgaatgctgttggatgacgggctcaaggctgaagacgggatgtttgccaatgtccttgcgggggacctgccggcagacggggtcgtcaccgggctcggaaaaatcggcggccgcaccgtttgcgttatggccaatgattcgaccgtaaaagccggttcgtggggctggcggacggtcgaaaaaatcatccgtatccaggagacagccgcgaaactcaactgcccgattttgtatctcgtcgattccgcaggcgcacggattaccgatcagatcgagatgttcccgggcagaagaggagcagggcggattttttacaacgaggtgcatttgtccgggaaagtaccgcaaatttgcctcttgttcgggccgtctgctgccggcggggcgtatattcctgcattttgcgatattgtcgtaatggtcgagggcaatgcgtccatgtacttaggctcgccgcggatggccgagatggtgatcggtgaaaaagtgacgctcgagcagatgggcggcgcaaaaatgcactgcaccgtttcgggttgcggcgatgtgctagtgaaaacggaagaagaagcaatccgttatgtgcaaaaatacttaacctattttccggacaatttttccgaaaaaccggcaagaacagaagcaaaggcgccggctgcgtttgaaaaaacgattgaggaactgatcccgaaaaatgaaaatgccccgtttgacatgtaccagctgatcgagcggattgtggatgaagattcgatctgcgagattaaaaagaagtttgcgcccgaactgattacatgtctcgcccggattggcggccggcctgtcggaatcattgcgaatcagccgcgggtgaaaggcggcgtgcttttccacgacagcgccgataaagcggcaaagtttatccatctttgtgatgcgttccatattccgcttttgtttctcgcggatgtccccggcttcatgatcgggacgcaagtggagcgggccggcattatccgccacggggcaaaaatgatttttgcgatgagcgaagcaaccgttccgaaactgtccgtcattgtccggaaagcgtacggtgccggtttatacgcaatggcaggcccggcgtttgaaccggactgctgcattgcccttccgtctgcatcgattgcggtcatgggccctgaagccgcggtcaatgccgtatacgccaataaaatcgccgcactcccggaagaggaacggccggcatttttcgcggaaaagcgggcggagtacgtgaaagacattgacatttaccggcttgcttccgaactggttgtggatgacgtcgtaccgggcaatgaactgcgggaagaactcgaacgtcggcttgaaatgtacagcgggaagcaggaagaattttcaaaaccaaagcacccggtatacccggtttaacattgaaaagcagctgcaggggcgcagctgcttttcaatacggctcccggaaaacaaaaatggcaacggaaaaagaccaatggtgcgcttttcttccttaaaacggggtatgaatgtattatcaaatgccaacgaggaggcgcatctatggaatttcggaaagccaatctggatgatcttcatcatttaatagagcttagaaagcagcagcaagttgcccaaggcatcgaaccgaagacggacattgatgccgatttggaaaagttttttcaaaagaaattaaaagaaggctccatggtccaatggcttgcggaagacgaaggagaaatcgttgcctgcggggctgtcattttttacgaatttccgccgagctatgtgaataaaagcgggaagaaagcctatattacaaatgtttatacaaaagaagaataccgcggccaggggatcgcgaaagaattgatggaaaaactgatggatgaggtgaaaaaggctggcatctccaacatctggctcggcgcttcggaaatgggcaagccattgtatgaaaaattcggtttccaggaagtggatgaatggatggaactacatttatgatgaaaggagagaatgagaaaaaccggtaatccgattccaaattctattttccttttcattttattatgaaaattatataatgttttaaaggagtcggaaaaaatgtctgattttgttcacgatacaaattccaatgtctattcagatggaagtcatgaatatttaaaagtcaattccttcatattaaaaataagtttcagttaaaagatcagcagttagctacactatttgggatttccgatgagaaaactacaaaaattctctctggaaagccatgctactttgatgaaggggagttaaaaagaatccattatcgtttaccgtttttaagtacaggattctcttttatagactcaaaagagagaatgagagcgataatagaggctaatttgataggagattataatctttcctatgaaacattaggtaagtatgccaatgtgccttgcgatgtgcttaaagctttttgtgaaggaaatgatcatattgatattgatcatttgatgaatatttgcgtaaatttgttaatgctatcttttgtattaagacctgaactttaattcattgtttaccgatcaaattccatccacggtttcttttgagtgctactttgatttgtccaaagaaacacttagaaaataaggccttacatttctgtgccttccaaagtgtatattttgaacttccccatctgccggtctatacttaaaatagtaaggaggaatgtacgatgtatgaaattgccattattggagctggtccggccggggcaagtgccgccatttttacggccaaagccgggaaaagcacagtgctttttgatggtggcacgagcgctaccaagcgggctttgctgaaaaatcactacggcgtaacagaaataaccggaccagacctggtcgaaaccggtaaaaaacaggcagcgcaattcggggccgaactggtcgacgaaaaagtcgaatcaattgaaaaaacggaaaatggttttaccattaaaacagaacaagggtcgtacgaaagcaaatacgttattcttgcaaccggcatgattgcaagcctcggggaagcccttggcgtcaaagccaaaccggcaacagaaccacgcgtaaaaaccgtttttgcagtggatgcgcaaggaaaaacgaatgtcccgaatgtatgggcatgcggcacggttgccggcgtctccatgcacaccattatcacagcaggcgacggcgctaaagtggctgtcaacctcatcagtgaaatcgacggcaaacgctgggtcgaccacgatgttttaggaaaataagccgttgtaaacgaaccgggcaaaattccgcccggttttcgtttgctttttttcaatgcgggctggaactgaaaagaattcgtcgcagatcaagcattctgacatgcttattgtttttccaaaatcaaaccacccactgcaaagccgggcactggggatgcagccggtacacgcgggattcaggcaatcatcaaaccttttttgcgtaaagccgtctttcctattccatgggaggattgttaaaaatggaatttatgattacaatagataaaaatatccaaaaaataaaccgaatttttaaaaaacggggagttgaggttcatgtatcgaatttttcaatgtggatttgtgatggcgtttacaggactatgtatgatgtttttggttcatcttgttgatggttattcaactgtagagctcggaaactcgctgattagtcaaatattattgattccaagattttttttgatttttggtatattattattgattctctctttcattatttggtttagaaattgggcgaaatctaaggcaaaaaaaatttcatgagttttaaagtagagtaggcttagttgggcctgctttttttgcggcgagcatctgtattctgaataagtgaggatgttattgcgataaacacggctcccgaaaccaggaaaacaatcgggtcaaattataattccaaaaaacggtattagccaacaataggtatgttatttgtaaaatgatttagaaagaatctgccaaaatataccactatcttttctattgaatttatagtaaaataaactgttagcacatagaaaggaggcgaacgtcatggcaaagaaatctatgattgtcaaacaaaaacgtgagccgaaatttaaagttcaggcttacacacgctgcgagcggtgcgggcgtcctcattcggtataccggaaattcaaactttgccgcatctgtttccgggaacttgcgtataaaggcgagattccgggcgtaaagaaatccagctggtaagccttccccgctccccttttttcggggcacgggatacatatccccgttctttccgcatctttgtaaattctttaatccctcttcatcataatttaacaaatcggtggtacgctaaaatcagcggggatggcaagcgtggccatcatcggtacaccgcgtaggcggagcgggtaccttgatttccagtacagccggcatgtttacttggaaatccaaaacctttcccttctgatttttttaaaaggaatttcggcatgcatgcagaaatttttcttttatagaaaatgaaaaaaggggaggatattcgaaaacgccgtcataggcaaaactttttatgacgagagatgtgtcaagtttttctcgattgtgagatgttgaaggcaggcttccaatgcgatcgagaaaatttttatacataggagaccgttgtcaaaactgaataggtagattttatgccaacactccactcaatatgctactattaaatcaaagcatttggaacggagcaatggcaatgaacacgaaccaagacttttttacccgtaaaaaagaggagtccggaattgtggtgaatgcagtgcagcaagaggccgtaaagcaaacggaaggtccgcttttgcttttggcttcccctggctccggaaaaacgacaaccgtcatcatgcggatcggctatttaattgaagaaaaaggggtggcgcctgcacggattaaagccattacgttcagccgtgccgctgccgctgacatgaaagaccggttccaaaagctttttccgaatcttccgcccgttgatttttcaacgatccacagccttgcttttgaactcgttcgcgtttttttcagacggaccaatgtccctttcttgctgattgaaggcgaggcggggccgtaccataagaaaaaaattttgcgggatgtatacaaggccattaacggggagaggatcacggaagaccagctggaggaactgcagacgtatatcagctacatcaaaaacaagatgatcccgcctgcaaaatgggggaagattgcgacaggtgtgccggaagctgcccggattttaaaagagtatgaggcgtttaaaaagcagggtaccggtcagctgcttcttgattttgatgatatgctgacgcatgcgaatgaaatattcaggcgtgatccgaatcttctctgtatgtatcaggggcgttatgactatgtgctgacggatgagagccaggatacctccatggtgcagcatgccattgttgaaaaacttgtgcggcggcaccggaatttgtgcgtcgtcgccgatgatgaccagtcgatatacagctggcggggtgcggagccgtcctacctgttgaattttaaaaaggtgtatccggatgcgaaaattttatttatggaacaaaattaccggtcatctcaagaggttgtcacggctgccaacctgtttatcaagcgcaacaagcaccgctatgataaaaacatgttcacggaaaacccgcctgccgggccgatccggtttgtgcgcctgccggattataaataccaggcaaaatatttggcccaaaacattgccgcatccgaaaatttctcggaaattgccgtgctgtaccgcaacaatatgtcttcgattgccctgatcaacgaatttgaccgggaagggattccgttttatatcaaagataccgacaaccgctttttctcccactgggtcgtccaggatattttgaatgtgatgcggctcacgtttaccgataaacgggcggatatcctcgcgcaggtccattcgaaactggacggttatattacgaaacagcagatggaagcggtaaaggggatccataataaccaatctgtttttgacaatttaatccaatacgcgcatttgaaggactaccaggtccaaaaagtgcgtgaagtaaaggagacgctccgggaaatgcggggcatgccgccgctggatgcgattcatgtcattcgcggcaggctcggctatgaaaaagcgctcgaaaacatgtgtaaaagattaggatttcgaaaggatcccctgattggcattttaaacacactcgaagaaattgcggacacgctttccaccatggaggaatttgccgcccgccttcagcacttggcgcacattttaaaaacggcgaaagggaacaaaggccggcatgctgtgacgctttcgacgttccacagttcaaaaggtttggagtttgaaaaggtgtatatgattgacttggttgatgggatcattccgggtaacgatgaaaaagaagatgatttactgatggaagaatcggtccgtcttttttatgtggcaatgacgcgcgcgaaaaagtcactggaaatggtcagctatgaaaaacgcaacggaagccgggcaatggactcaccgtttgtggcagcggtgaagggaattgtcaacagtgttgaaaaggccggaaaaacaaagccagaaatagaagttgcccgaatcggcaaaaagacggtctccatcccgcagaacccgaatgccattaaggacgcatccgcttttgtggccggtaaaaaaatccagcaccgtgtgtttggtcatggtgaaattgttgatattgatggtgacacccttgccatccggtttgaaaaacggacgataaaactgtctgccctcacctgcatcgaaaaagggctgctcgaggaagccgatctgtaatcgtgtgtggaaaaacggaagcggatataaaaaatgccgggaatttcccggcattttttatatccctgaccgccgcaacaggctcacgttgtacggaggcaagggattcggcgatcaagtcctgtgcccctttttattgaattggaacgccccaggccatttggatgactgcaacaaaggtgccatccggttggtgccccgtgcgaatgggagcagagcctccttgctgtttggcagcattcccgagatttactgctcgcggatgctgttttcctgcgtatttctttttttcctccaaatcagcagctgttctgtcaaaatgccgaccacagatccaaggattaagccgttgtttaaaaaagtagcgatcatcattggcaaatgttcggtcgcatgagccggcaaaaacatcgccccgattccgaccaggaaggagatgcctgctgttgtgtgggcaatctctttgtccgggcttttttcaagatcatttaaggcaaggccaaccaattgtgtgaagaccacaaaggtaacggcataaccaaccggcgcgggaatcgcagacatgatatgcacgagcggtggcagcagagcaatgatggaaacgaaacaagcaccatacaaaaatggtttcagcacttttataccggtttgtgcaacatagcctgccgctgctgcaatcggaaccgcaccgacagcggaaaagatgccggcaagcagctggttgatgccggatatgaacagactgctccgcacccgctcttggcggactcccgtcacatttcccatgacgcgcacagacgtaatcatattcgcagttaacaaaagcccgatgaatacaccggttgtgacggcaccggaatcaaaacgcggttttccaaaatcaaacacagcgggaagagagaaccagctttccccaaatgtaatagccggtgcttcaccgaaaagcgcgaacaaaatccagccacaaatcaagccgagcatgatcgaatattgcttgacccacggtttctttacatggccaaaatagaatgtaagcaatacggtgacaaggctcaaaacggcaacaagcggccggacttcctgatgggcacccgtaatgccgagcatccctttcataaaagagccgctcaactgcagcaccaaaagcagcaaatagataaatgttactaccggcgtaaacagtttatttaattggtccacaaagccggtaaaagcgagtagaaagaaaaagatgccggttacaatcagtgcgcctgccaaatattgcagagattcagtgcttgaactgtacaagctgccgacaagccctgcataaatggcaaacacgctccaccacagcccggccggcccttcattgatgggcattctgtggccgaaaattccttgcaaaaggccgccgatcccgagtacaaaaagcgtccgctgcacaaacagggcagtctcacctgcactgaaatggaaagcatccgcaatggcaatcggggccgcgatcgacccggcgatcataaatgccatccattgcagcgacgaaatcaatgttttcatagacacaccgttctttccgttcaaaaaatggaaaataccagtaaatataattatagcaaaacaggttttacattttaaacataatacactttgcggacgagggagggatagcgggcatggcggatagcggcataaacaggggttgcaaaccggacggggcgcgggttaagccatgttttttgcctctatttaaatgatatatatgtggcaggggctaagctatgtttggatccgcaaaaaatttctgggcgatcttcatgcagaacgctttttgtttgtcactaaaagagttgcggctgcctttacttaggcatgctatctcgaaaaaaattatgatggataatttttgctggtgctacgtggtagcggcatggccggttatgttgaggaagcgaggtcaaaaggtgttgtttcttaacatagagcgcgtctacgttaagaaagcgagcgaaaatagctttgtttcttaacatagaggtcgtctacgtaaaggaagcgcggtaaaaagacgttgtttcttaacatagagcgcctctacattaaggaagcgagcaaaaaaggcactgttccttcaaatagaagcgtctatgttcattctttgccaaaatttgtttaggtaaaaacaatccgggcaatggatcccttgcccgaaaacattccttattctgtgacgcttacgctggcgctggcaactgcccgtttgtgtcttctgattgtatagaaaatgaggatggcccatattgccgcaatggctgtataggtaacgccgtaccagccgctaccggcgcccgccatttttaataaagtttgcacgttgctgaacacaatcatgccgctgactatgacagccagcaaatgagccggcaggattttaaccagataggctgcaatcggtgcggcgatcaggccgccaagcatgagggcgatcgtccaaatccagttaatctgcatagcgccgagggataaaaggaaaccgatgcttgatgctagggatacggcaaattcactggtatccaccgagccgatcactttccgcggttcgatgtcatttctggaaagcaaagccggtgtggcgataggaccccagccgccgccccccgttgcatcaaaaaatcctgcgacaaagccgagcgggataaaaaatacgtttgaaccggtcttctttttgactttcaacgccccgcgcgcattgatcagaaaccggataagaatatagaggccaagggcgatcagaaaaatagaaatgtacggttttaatgtgctcgcaggaagatggctaagaacggttgccccgagaaaggcaccgacagctcctggtacaaccagtttccaaatgatccctttatcgacattcccaaatttcatatgtgaaaccccggaagccgccgttgtaaaaacttccgccaaatgcacagaagcggatgcgacagccggcgcaatcccgaaagccagcaaaagtgaggttgaagtcaccccgtaacccattccgagagatccatccaccaattgtgcggcaaggccgacaagtgctaagacaattaatttttgcatgttcatgttccccgctttcttcatccataaatttgattcatcctgatgtagaggaattatacgcatcagggcctatcctggttcaaacggccggccttgcagaaataaaaaatctttccgccatttttacggaaagacagcgagtaaaggataagcgcttatctttcaaaatggtacccattttgctggaattggcaccttgctgctcgctgcaggttgccggacttcatagggccagatccctccgtcgctcttgataagtaatttgttgttgtttaaaattttatcagaaaataaatggaagtcaatataattattgcaagtttttttatcggatttatacgaatgaggggataaagaaaaaactccccatcagatcacgctctgtcgggagtttttttctttacgctggatgggttttaaaaagcaggtcatcaggaccaggcggggcatcatggccgctttcattcgcttcacaaaacgaaaaagagtccaaacgggttagcgtgccgcccattctggcagtttgatacgcgctgcacacccgtgcctgccccccctccgagtgaaccggttttatcaacaccgctcgttggtgcccgcttatcgcgcagttggatttctgccttctccccgcccaagtgaaccggttttatcaacacagcctgctggagcctattcctttcctttgattctcagtgacaggacgaccagcacgattaaaatagcgaggcagacgcttgttccaatcggattgccgccgcccagcaaaaaggacaggaaaatgcccgagagtgcaagcagcgcaatccagaccatgaaaggatacccttttacacggaaggaaggcaattttgcatacgacttccggagccgcagttcggctgcacagatggcgatccagacaaggacgacggtaaatcccgggatggtcatcaaatagctgatgacctcatccggcgtaagataggccagaatcacgccggctaaaataaacagcgaggtcagcaaaatactggtgagcgggacgcctttccgggaaatttttaaaaaggcgcgcggcgcttctccggactgcgccatgttaaacagtgtgcgcgaagtggcataaataccggaattggcggcagaaagaacggccgttaagagcacaaaattcatcacatgggcggcagcagggatcccggtgcggctgaatacctgcacaaacgggctttccacggaagaaacctggttccatgggataatgccgcaaatgatcaggattggcaaaatataaaaaagcatgacacggacaacggtctgtttaatgacacgcggcagcactttttcgctgtctttcgtttccgaaacggtaacgccgattagttccgcgccgccgtatgaaaacataacgatcagaaaagcgctgaacgtaccgtgaagcccgttcgggaaaaaaccgccgtgcgcggtatagttagacaccgtggaagatgtcccggggaataaaccgaataaaatcagagcaccaagcaggataaaaacgatcaacgtgataattttaatgccggcaatccaaaattcaaattcgccgtagtacttcacttcaattaaattgatgccgaccacgaaagcagcacagagcaaactgagtagccacaatggcgcttggggaacccagaattgcaggaagctcccggctgcaagcagttccacaactgtaacaatgacccagttgatccagtacagccagccaataatgaaagaaacccggctgccgaatgctttgtggatcagattttggacgtttaagccggggtggacgagcgccatttccccaagtgctgacatgacaatgaataaaagtgcgccgccgatcaggtaagaaacggcaacactcgggccggcaaggctgacggtatcggagctgcctttaaaaatgccggttccgatcatcccggccaatgcgatgaactggacatgccttggtgataagcctttttgcaaatgatgtttgtttttctccatttctatcaatctcacttttctgttttagataaacgcttttcagtgctaaagcatttattctattttagcagaaaaaaaggaatattgatatacaaaaaaatggaatcgccggatgacagatccaccctcatttcacaccaaagcaaaatgcaaaaaacggcgggacaccactcatcgtagtatctcgccgttctgtttaatatgtgtcccgggatggttgccgaagcgctgaatatccatatttgaacatgtcgttctatttaacttgtgctccgcgatgggccgaaagaagaggaaaatgcgcggacggatcccctattcagcttactttttatcaaacccttgtcgttctacaaattccttcataaaaacgcgcgacggttctttaaaaaattgtgccatttggcctgtccaggtatcgttcctttttccgtttgtgcgttttgtataatattgcgaaaccgtttcattgtattccttcagatcgcgcaaaagacgttcatcagccgggtattcatcttcgaaataaacgtgctcagcctccatgcgtggttttttcgcagacggatcggccggatagccaattgtcatcgcaaatagcggaaggacatattgcggaattttcaaaagttcggccacttccggcagccggttgcgcaagcctccgacataacaaatgccaagccccatcgattccgcagcgagcgcggcattttgcgcggccagtgccgtgtcgataagcgcgaccataaatttttccgttgtctcaagtgtatcttgcgcctctacgccttccatttgtgccgcaagttcatgtttatggagatcggcacagaaaatgagcagatggccgcatgttccgacatgtcggttcccggtcagttctgctagcttttgcttccgcccgggatcctgaatgccgagaatcgtataggcctggacaaaatgagaagtggcggctgcctgcgcggattccacaatcaggcggatttgttcatcagatagcggccggtcttcataatggcggatcgaccggtgattgagaatcgtttcaatgatggtattcattcctttacactcctgtctttggtgagtccactgtatgttcaaatatagcacagaaaaaaacggccggcatgaaaggtgcttgttgtccagcatggccacaatgatctgccaaaaaatattttgattaaggctaaattaacctattttcgctttggtatacccaaattgaacttcgagtatgttcatgcggagggcggaagaacattttacccttctccattatttatatatccgcctttatgatgccagggggggcgaagtcagtgaaggcgttcgatttcattttgcacaaacgtaattgtcgcatgctgctatatcgcgccggccgaacctctgaagtcccggaatttccgtccgatgaaaaaaacactgcaaccctgatccggagggctgcagtgttttttgctattcgaaattaagctgatagtcttccgatttgatcatctttaatttttttgaaaaaacataaatgaatccgacatttaagataaacggcagcacaaagaaagtgctcagcataatggcaatatttttcgcagtccagccgccttcagcaagatgcatgaaattgagcgggccgactaagcccgacaacccgaatcctgcactgtaaggcgtgccctgaatatgaaagacgccggcgagcgcaccgagaacggcagcagtgatgagcatcgggaaagcaattttcggtttcataaagaagtttcgcatctgaattttcggcgagccaagtacatgggcaagggcggtaccgagcgagttggctttatagctggcgatggcaagcccgaccccggcggcacaaatgccaagatttgccgcccctgaactgacacctgaaagcataataacggttgctacgccgactgttgaaatcggcgataaaataatcaggcaaaaaatgacggcaataatggcgcccattacgacaggctgcatgcttgtcacatgtgccaccccgacgccgaccagcccggtagccgctttaataaatggcaaaattgtaagtccgatcatgcccggtattaaaatactcaatgtcgggaccaggaggatggaataagcctttaaccttgttccgacccacttgacgaataaaaccgccaatgccgctgtaatccctgtattgatgacaatcccgatcccgtttaaagcaaatgcaccggcagccgttttctggatcgcgccgctcccaaccattgcggcaatgccgacacttgcaatttggatcggtgtcaattgaaaggtaatgccgaccataacgccaatcaatacaggcagcatgctcatgatgataacggttgcatcaacaacatgctgcaaataaggcgcatgcgggataatcagtttcaatatctccccgagtaaggcgtttgggatcagagaaacgacaatgcctatgctcattccgtttaacagtttgctaaagaaatctttcattattggaagcccccattttgttttgacctcgctgctgacgctgccggataagcgccgatgcttgtctgtttgcgtatgattatataaaacattcagattatagtcaacaaaaatttttaatactttaccgcgtgtgtgcacatatgcataaaagtgctaaaaaccatataatatgaacttaagtttttcgtgccaaaatcaattacgatcgggatagacattgcttttggcaacacataaagaagtaataatgtttagttcagcttatatatagggcttgctaaataagcaaaattcctaaatttggcaagaatgctgacagctttggcaaaaattcaaatgcaaggattttataaaaaatccagggaaaagctgaatcaatgtatagaaaagacagaatcacgcattttcaaaaatggcttcttctagagcttactgacaaattgggtacaaactcagaattggattcgttcagcaagccctatataaaaaagtgatcgaaaacaatctcagatatgattgaaacaattgaaatccgtgattgctggcatggcatgaaaaatgattttttttcacgatggaagcggtataataaaagtggtgttttagaaggtgttgtgccgggcaaaagaaaggacataaggatgcggagggatacgccatgaaaaaaattataaacgaccctggaaaagttgtcgatgagatgctggatggatttgtgtacgcccatgaaggaaaagtggagcgattggaagggacaggcgtcatttatcgtactttccgggatgaagggaaagtggcgctcattagcggcggcggcagcgggcatgaaccgagccatgccggttttgtcggggaaggaatgctgtctgcggcagtttgcggtgaagtgtttacctcgccgacgccgaaccagatttttgaagcgattaaaaaagccgaccagggcgccggtgtgttcatgattgtgaaaaattatacaggggatgtcatgaattttgacatggcccaggaattagctgaaatggaagatattcaggtggagaagatcgtggttgacgatgacatcgcggtagaagacagcacctatacagcaggaaagcgcggcgttgccggtaccgtccttgttcataaaattctgggcgcggcagcagcagaagggcagacgcttcaggaaatcaaggcgttggctgaacggcttgtgcccaatgtgaagacaatcggcgtcgcgatttcgccggcaacggttccagaagtcggaaagccgggttttgtccttcaagaagatgaaatggaatacggtgtcggcattcacggggaaccgggttaccggcgggaaaaaatcaagtcgtcaaaagcgatcgcggaagaactcgttacccggctgaaaaatgcgttcaactggaaagaaggggaccggtttgcgctccttgtcaacgggcttggggctacgccgctgatggaacagtatatttttaccaaggatgtgcatgccctgcttgaccgggaaggccttaccgttccgtttagaaaagtgggcaatttgatgacgtccattgatctggccggcctttccctcacgcttgtaaaactggaagatgaggcgtggcttaaatttttaaaacgaccggtatccgttccggcatgggtgtaaggaggcggaaatatgttaacagcagaaacagcaacagactggctgcatcgttttgcagaaaaaatcaatgaaaacaaagcctatttgagcgaactggacagtgcgatcggagatggtgaccacggttcaaacatggcgcgcggggtggcggctatggaagaaaaactggcagctggcggttttgccaccgtccaggacgtcttgaaaacagcggcgatggcgttgcttggaaaagtcgggggtgcctcggggccgctgtatggctcggcgctgattgcgatggcaaaacaggcaggggaaaatgaacaagatgttgcggcaattgtaaaagccgggcttgaaggcatccaaaaacgcgggaaagcggaaaaaggcgagaaaacgatggtcgatgtctggatgccagcctgtgaagcactcgcgtccggatcgctgacaaaagaggtcattcaatctgccgtggaggcgacaaaagagatgaaagcgacaaaagggcgcgcatcttatcttggtgagcgttccatcggccatcttgatccaggagcggtgtcgagcagctatttgtttgaagctttgttggaaggcgggattctggatgagtaaaaaaccagtcggcattgtcattgtttctcatattcctgaaatcgcagccggccttgccacattgttaaaggaagcggccaaagacgtttccattacgtatgcgggcgggaccgatgacggcggtgttggcacaagttttgacaaaattaatgccgccatagctgaaaataaagcggatgatctgtttgctttttacgacctcggcagcgccaaaatgaatttggaaatggcaatggaaatgtcggataaatacatccgtctgatggacactgcctttgtcgaaagtgcctatacagctgccgcgctgatccaggcagatgcagaactggaagaaattttaaaacagctggaaccattaaaggtaaaataaaaaatagcccgggccggtatgaacggtccgggcattgcttttttgtggaaaaacataggaactaggcgactgccccaatggccatgaaacgtggggcagccttcatcaagttttcacgaaaaaacggatgccttaaaagcctgttctaaaaaatggccatcaagaaaaaaacgaacctcgcactgtatgcatgtcagagattcacgaaaaaccggccacttgtctcccattttaaagtctattttgcacgcccacgctgtatggatgtcagagatttacgaaaaaccggccgccttgctcgtcacgctgtatggcgtttgaaaggccgtcaacaaaacggaatcccgcgctgcatgcatgtaaaaggttcacgaaaaaccggtcgccttgcctcccacgctgtacggcgttcaaaagaccattaagaaaaaacggacctcgggctgtatgcctgttaaagatttacgaaaaaaccggacgccactttcaatgtcataataaagtgacttcttcctctacgcttgcggcagcggcaatggactgttttaaaatatccaggccttcctgcagctggtcgtctgtaatgacaatgggcattagaatgcggatgacattgccgaaaatcccggcatccaaaagaagcagcccccgcttgttggcttctttcacaatccgctttgtcaatgctttatccggttcttttgtcgttttgtcttttacgacttcaaatgcacacatggcgccaagtccgcgcacatccccgataaaggtaaactccttctgccagctgcggaacgtatcaagcacatgtctcccgattttttccgcccgttcgtttaatttttcagattcaatgatgtccagtacggcaagggcggctgcgcatccaagcgggcttcccgcataggtcccgccaagttcacccggatttgccgcatccattatgtcgctccgtccgattacaccgcttaacgggacgcctgctgcaagagatttcgagatggtaatcaaatctggcacaacatcaaaatgctcaatggcaaaatagcgcccggtccgactgaatcctgcctgtatttcgtccgatacgaacaaaatgccgttttcctggcagaagtcataaaccgcttttacaaattttttgcctggcacaatgaatccgtcttctccctgtactggttccatgaccacagccgcaaccgtttcagcggcaacatcgttttgaaagaaattccggaactcttggatcatatagtcttcatattcttcatcggtcaaattgccgggtttccggtaagcataagggtaaggcgccttataaacttcagaagcgaacgggccgaattcgtatttatacggcttcactttgcttgtcatcgacatcgtcattaacgttctgccgtgaaagccgcgggtaaagctgataatggccggccgcttcgtatatttgcgggcaattttaacggcattttcgacggcttctgccccgctgtttaaaaggatgacctttttctccgcattccccggagcgagcgctgccaatttttcagccagttcaatataaggttcatacatcatgacgttaaagccggtatggataaaacgttcaagctgttctttgacagctgcgacaactttcgggtggttatgcccgacattcagcgtgccgattgcgccggcaaaatcaatatacgtattgccgtccacatctgtaacaagcgcgccttttgcttcttttgcaaaagccggaatgccgttgctgacaccgcggggaacggctttttcccttctttccagcagttctttcgaaagcggccccggtagagaagagtatacatttgcatttgtcattttaacgcttcctttttattagttgatgatatggatgtaaccgatctgtcattatggtccttttacaagattatgatattacaaatattgcaaaaaaacaaacgcattttaaggaaaatttatcgttttttgattcatcttttggatagcgggtaaacagcgaataaaaccgccatgatccctcctgatatgcataaggcgggcaatgcgattctttgacaaaaccccctcctgcctttaagatggggataacggatttgcattgcaaatttgaaggagagacaaaaatggaagttgccatcccgatagattttgagcagatgaaagaagtcaaaacagagttgacgcggtttatgatgtcgtataaattcgcgctccatgaagtgatgacaaaaattgatattttaaaagaagaatttcagtacgtccatgactacaatccgattgagcatgtaaaatcacgcctaaagtcaccggaaagtattctgaataaagcgtaccggaaaggctgtgcgttatcgcttgattcaatccgtgaaaacatccgcgatattgccggcattcggattacatgttcgtttatttcagacatatatgagatcagcaaaatgatccagcaacaaaaagatgtaaagttaattgagtgcaaggattacattcaaaatccgaaaccgaacggctaccaaagcctccatatgatcatcaaaattccggttttcatgtcggacaggtcggaagaagtgtatgttgagattcagatccggacaatcgccatggacttttgggcaagcctggagcataaaatatactataaatacgatgaggatgtgccgcaacatttgaaggaagaactgaaagaagcagcactgcaggcagcacaactcgatgtaaaaatggagaatatccaaaaagaaatgaaggaagtcaaaaaacgaaacagtgaaaacagcgtgcaccaactgattgtagatactgaaaagcttcgaatccctgaagattttttaaaagcggccttaaatgaaacggatgggaagggatccatttgatcattaatttgaacgaaatgccgggatttgtccggtttgaaatggagaaattaggggaaatgatcgccccgaaactgaaaaaagccaaccagtatgcattttggtccaaaccgctgatctttgtggcagcgctcaatttgtttttgttgcttctcgtgatgccggcggaggaccgctcgattccgctcctccttttctgtgcggttgctggggcgttcggcatggcgctgtcgcaggaagcgcgcgttttgagaaaagaaattacgaaactcagtttttcctatatgaaaaaacggattgaaaaaagcagtattgtcccggactcggtgaaaaaacgctatgcggcactaattgaaaaagaaccgacgaatattttcctccattttatccactttttggaagaagagcaaaacagaaaaaaagagctttggtaaaatccgcacggcccgttgatggcgtgcggattctttgaatttttatggacggatgggaaaatccaacactcctgcggcatttttacgctcgtttgtctggatgcgtggggatttttgcccgctcgataggccgggcgtttccatgcaagtttttctcgccatgcggcttcttggtgagaatagccggaaaacgggcgaaaccgaaacactttgcatgctgctaacaatatagcgggctgccccttttttatacattagcgctttcaaatttttaaaagcaccctaaaaaagctattctctttccggttcgtgcccgattgtgattaagcgcgtctccacgttgatgtccaaattcacatcgtatccgcagtttgacacctgaacggatgcatcacgaacagagaaagcaaccaccgtatccagttcgccatccagcacggcaaaggcatactggtcttcctgatttgtgtacaaatggtatgattcgtgaatgacaacggtccatcggtatggcaggaataatgtttttgtgcccatgtctgtctctccctgaaaaaatgtagttatctaaactatattcgttccctgccgccagaattcctgctttcgctgcggcccattttgcaacatctgcctgtggaaatcggcggcaaattcgattacaataggaattatgcgaaaaacgccagaaaagaggggtagaatggaaaagaaatccatttttggattgacgatagatcaattgaccggctggatgcttgaacacggacagaaaaaattccgcgcccaacaagtgtgggaatggttgtaccaaaaaagagtgaaaagctttgcagagatgacgaatgtcaataaagactgccttgcgttactcgaagaacatttccatattcacacgttaaaacaagtggtgaaacaggaatcaaaggacggcacggtaaaatttttgttccagctgaaggacggcaatttaattgaaacggttttgatgcgccagcattatggtttgtcggtttgcgtgacgacccaggttggctgcaatatcggctgttccttctgtgcgagcggcctgctccgcaaaaaccgcgatcttgaaagcggggaaattgtcgagcagattatgtacgttcaaaaacattttgatgaagccggaaagggcgaacgggtcagccatgttgttgtcatggggatcggagaaccgttcgataactttgagaatgtggtgaacttccttaaaattatcaatgcgccaaagggactggcgatcggtgcgcgccatatcaccgtttccacaagcggccttgcaccgaaaatttatgcgttcgctgatcttgacctacaggtgaatttggccatttccctgcatgcgccgaataatgaactgcggtcgcgcatcatgaaaattaaccgcgcgtacccacttgaaaaactgatgcctgccatcgattattatttagaaaaaacaaatcgcagaatcacgttcgaatatattttgctgaaagatgtcaacgaccataaggaagaagcgctgcagcttgcaaaactgctgcaggacaagcgtcatcttgcctatgtcaatctcattccgtacaaccctgttaatgagcacggttatcaaagaagcgaaaaagaatcgattatgacattttacgatacgctcaaaaaaaatggcatcaactgcgttgtgcgccaggaacacggcacagacatcgatgctgcatgcggccagctccgcagtaaacagatcaaaaaagcaaacagaacggcgtaacagcgagctcgcccgtattttggattttatccaaagcggagcgggtttttttacgtttaaaaaaacgaacaaacagggtaggtatagggtacagcaattatatgctgaaaaagtattttaacaatatatgaagatcacaagataggaaaggaatgagcgtaatgagaggaaaagatgatggagacgagggcaggcgtgtttcagtccgtaccgaagaagcgggaacaagaaaaaaatcattttccaaaaaaacttttctacgtctgattacaattatctctacgtttggcggtttactatacggctatgatactggcgttgtcaacggggcactgccattcatgtcaagggccgatcaacttgatttaacgccgtttacacaagggcttgtcacaagtactttgcttttaggggcagcattcggcgccgtgttcggcggaagactttctgaccggaaagggcgccggaaaacgatcttaagcgtcgcttttattttcgtcatcgccacgcttggctgttcgatggcgccgaatgtggccactatggttactttccggatgattttgggccttgccgttggcgcgacatccgtcacagtcccggcctttttggcagaattgtcacctgctgaacaccgcggacggatcgttacacaaaatgaactgatgattgtcaccggacaattatttgcttatatttttaatgcaatactggccaacacgttcggggaagccggaaacatttggagatacatgttggcaatcgcaacattgccggctgtcgttttatggctcggcatgctaattgtgccggaaagcccacgctggctcgcggcaaaaggcaaatttgcgatcgcgcttgatgttttgcggaaaatacgcaaggaaaaacgggcgcaaatggagttgaatgagatccgccaaacggtcgaagaagatgccaaaatgaaaaaggcaactttgaaagatttaaaacttccatttgtccgccgcatcattttgatcggtgtcggcatcgcaatgatccagcagctgactggcgtgaactccattatgtattacgggacggaaattttaaagaaatccgggttttcgacaggcgcagccctgattggaaatattgccaacggtttgatttccgttcttgcaacttttgcaggtattgcacttttggacagagtcggcagaagaaaaatgctgatcacagggcttgcagggacaagcaccgcgttgcttttgatcggaattttttccatcacgttaaaaaacagtccggccctgccgtttatcattttaagcctgaccgtcctgtttctcgcttcccagcaaggcggcgtgtctccggtaacatggctcatgcagtcggaaatttacccgatccatttaagaggacttgcgatggggatttcgattttctgtctatttatgacgaatttccttgtcggtctgttgtttccggttttgttaaacgcaatcggcctgtcggcaacattcttcatttttaccgggtttggcatcctctccatcctgtttgtaaaaaaattcgtaccagaaacgaagggtcggtcgcttgaagaaattgagcaaagtttccatgcgcggaaggagcgttactttgcacgcagaagaaaatcaacctttaaccggagcaaccggccgcagcacttacatcacagcggcatggaccggtaaaaaatttttcgaaaagggtccggcgcgggcccttttcgcttgtccgaacatataatagaataagaagtttttccaaaaagatgtaaagtttcctgacgccgaacaagacagtgtttcaaaataggtgtataatagaagtgaaaaatacagattttactgactaaaggaggtgttgtgagatgttcaactggctgaaaagaaaaaattcaaaagtggttacacttgtttccccgatagccggcaatatgattccgtgcaaagatacgggccagccaggtaagggcattgccatccagccgcttgaaggaagggtgcattcgcccgcagcaggaagaattacgcatatttctccggaagataacgccatcagtatattgacagaccaggggcttgaaattacaattcgcctcaatacagaagaagccgctatggaaagtgaagaatttgtgatcatggtcaaagaaggcgatcacattaccgccggaactccgctcatggaattttcctttcaattgacagatgccaaaacagaaaatctttactcctctgtctccgttgccaatatggatcaagtcgaaagcatggaagtcccgccggctcagacaatcggcctcgatgactgggtgatgcgggtaaaaatgaaatcagggaaccgggaataatcttttttaaagaaggtggctcccattttttaccgtttgttaaaagggacatagaaatgccgtaaaggcttttgttctttacggcatttttgtgtgcattgtagaaaaatcgttaaaattgcttttccgtggctgtggtatggtgaaaacaggaggtcgatcgccatgccaaaaagggagttaaacaacgggccggtcatccaaaaagaaaaggaaaccgtgtcacaaatgattgccatttattgccggaaaaaacaccaccgcaagacgctttgtgaagaatgcctcgatttacaaaactactgcttaaaaaggctttcctactgccggtttggcgaggaaaaaagcgcgtgttccaactgcaaggtccattgctaccggaaagactaccgtgaaaaaatcagggcggtcatgcgtttttccggcccgtggatgcttttgtaccatcccgttttttccatccggcatttattaaaaaaataagtttgggtgatgcatgatttgtaaatgattttacataaatggatttatccggctgaatatattatgataaaaccgtatgaaattctttcatcaccaaggagcagaaaaatatgtataaattgattgccattgatatggacggaacgcttttaaacgaccagcatgaagtcactccggaagtccgggaagctttacataaagcgaaaaagagaggcgtcaaaatcgtactgtgcacagggcggccgatcgggggcgtccgccgttttcttgaagatttattgctgaacgaagaggatgattatgtcattgcctataacggtgcgcttgtgcaaaatacgcatacgaacggggttgtcgcggaacggtcgattggttacggggatttggtgcgtctgtacgggctcagcctcgaactgaaaacgccgatgcatttttttgatccggaacatttgtatacaccgaaccgggatctcagtccttatacagttgtggaatcttatttgacacagatgccggtgcattaccggacattggaagagctgccgcgggatatggtaattccaaaagtgatgtttattgacgagccggagaaactgagccggacaattgaagcgattccggactgggtgcaggagaaatacacgatggtcagaagcatgccattttattatgaaattttgcataaagaggcgagcaaaggcaatgctgtgaaactccttgccggccatctcggcattcgccgcgaggaagtggtttgtatcggcgataatgaaaatgacctgactatgattgaatatgccggctgcggggtggcgatgggcaatgctgtcccgaaagttaaggcgattgccgatttcgaaacgcgcacgaacaacgaacacggcgtcgcatatgcaattgagaagctggtgttgtcgtaaaaaagaagggtgcccgccggcggaaggcaggcacctttctttaaattggattcgggccgggctgctccagtgcttcagcgagttcaccgcaatccgggcaacaaatataggtgtcatacaaatgatacccgacatagccgtgcgtcatctcctgcatatcccaaatcgtttcccattccatatcgaaagtcttgttgcagtgcttacagtaaaacatcacacgcccaaaatcttcatgttccctttcctgcttctttttcttcaattggatcaaaccccattctaaaaaagttttaactgttcggcttttggttttttgtgatgtatcttacagacaggttgtccttcttaaaaataatattcagtcttttcctatcttttttcttctctgtattgagtgtactttcataaggtaaaaagttcaactccccctatttgggcgaccctaaacggtatcttccaaataggacaaatttgcaaactatgatctgcatcacgccatttttacgccgtcttgtttaaaataaaggatatgacaaagaaagagggaatccacatggaaatgccgcattgtgccatggtcggcggcgcgagtgatgttgcattgtgcgcaggcctcaaccagttgaaaaatgagcatgggcacttgaatgaacgaaaacgcgcattgtatgaaacggcagggcagataataaacggtgaactcgaaaataagcgagaagcccttgacgcactccggaaagggactgaatccttttccgcgcagttgaaacaccatgccgaacgggaagaaaacgtgctatttaccatgatggcccgttacattggacgcgaaaacgggccgatcgccatgatggaatacgagcatgatgaagcagaaaaatatattgagattttcttaaatggcacgaaaataatggatgaagaccaggccgaagtgctcgcttcctatatcgtacaaatgtatgagttgctcacaaaccattttttcaaagaagaaaacgtcctgtttccaatggctgaaaacctgctatcagcggctgaaaaagacgagttggaagaaaaagtctgtacaactggattacagtgaaaatgggcaaaaagggctgccccggaaccgggagcagcccctttttactgtcatgcccatttttccttataataccgcccgacggaatctgcggtaacgattgctgcgtacacaaggtcaggcgtgacttcaaacggcatgttataaatcgtttcgccttccgcacaggaaagttcagccactttccggagcttttcctcattcagttctttcacgcccaaatccccgagcgtgacgggaagtccgacactcaggcagaaggagaccacctcttcaatttccgctttcggcgcatcttccaaaatcagctgggcgagggtaccgaatgccactttttcgccgtggtacatatgatgggtttcttcgagcacggtaagcccattatggatcgcatgtgccgcagcaaggccgccgctttcaaaaccgattccgctcagataagtattcgcttcaatgattttttccactgcttccgtaacaagatgtttttccgctgccagttttgcttttaaaccttccgaaatttgcgtgtcataacaaagttttgcaagcgcaatcgccgcttccgtaacatgaccgcctgccatcgtcgttttatttgcccgcttagtggcgcgcgcttcaaaatacgtcgcaagcgcatctcccatgccggaaacgagcaggcgggcaggggcagaggcaatcactttcgtatccataatgacaaaagtcgggttcagcggcaacatcaagtattcttcaaactcgccgttctctttgtaaataacagacagggcgcttgtcggggcatcggtggaagcgatggtcggcgcgacaatcaccggaatgttattgtaatacccgactgcttttgcggtatccaatgtttttccgccaccgatcccgaccatgacatcggcttcttgcgctttgcaggcatcacaaagccgtttgatttccggtttagaacactcgccaccgaataatgccatttgataccccgtttctttgccggcatagctttcttcgaccgttttgccgacaaggccggtgacaaattcatccgcaataataaatgcttttttgccaagcctttccgtatacgccgaaagcctggacaattcatcggggccttgtataaacttgcttggagaggtaatgattttcgtcatagaaatgcctcctctttttgtgaaaaatataacaagcacaattccatcataacttatttttgcaaataagaaaaccctttcatcctatcatccatactttttcaaaaacgttcaattttcggggaataacaagtaaaatagagctgtatcgacaaaatgtgacagaaatatgatgtgttttgaagaaaaatgatattttttgattgaaaacggttgattatgaataactatgtgataaaatatcatcagacggaggaatgaaggatgttagcagaagaacgctatcaaatcattttgcggcatttgcaagaaaagcatatcgtaaaagtgcaggagctggttaacctgcttaatgcttcagaatcgacggtcaggcgtgatcttcaggacctggaagcaatgaatctgctcaggcgcatccacggcggcgcatcgcttttgcaacgcagaagtgaagaaccggatatggatacgaaaacgctcaaaaacgttcaacagaaaagaatcatcgcccaattggcggcaaaaatgatcaatgacaatgactgcatttacctggacgccggaacgaccacgcttgaaatgatcccttatatagaggggaataatgtaatcgttgtcacgaacgggctcccgcatgtggaagcacttgtcgagaaaaaaatcaagtcttaccttctcggcgggatgatgaaacggacgacaagggcggtgatcggtagcgttgccatgcagacattaaacagcttccggtttgacaaagcatttcttggggcaaacggcgttgaccctgaaatgggctttaccacgccggacccggaagaagcattgatcaagcggcgggcaaaagaactttccgaacagtgttatgtgcttgcagacagtagcaaatttcaggaagtagctttttgcaagatgtttgacatttcggaggcttatattatcacggatgaattaccggattccttaaaatcttccattttaagtaaaacgaaggtaatatgtgagcaaagcggcgcataaaaaagttttcctccgccatgataaaagcccgcagttgaaacaaaataaaaaatggctgtctcaggcatccggtttggatgtcatgataagaggtattgtttttctgtactggaaaaaggagtgaaataaaatgaaaataaccgatttattggtccaggagaccatggttatggatatgcaggcgacgaaaaaagaagaagcaattgacgaattgattgcaagcctgtcaaaaagcggccgcatcaatgacccggttctttttaaagaaatgattttaaaacgcgagcaggagtcgagtacaggaatcggcgacggaatcgccatgccgcacgcaaaaacaaaagcggtcaataaagcgacagtcgtattcgggcgcagcaaaaaaggcgtcgattacgaggcgctggacggccagccatcctatttattcttcatgattgcagcgcctgaagacgcagcggatacgcatttgcaaacattggcagcattgtcgaggcttttgattgaccaggagtttgtacagcaattaaaacaggccgaaacgccggctgaagtggcgaggctgttcgatgaaaaacaagcggaaaaagaaggaaaagaagcagcggaaacgggtgccggcaatggttcggatgacaaattgatcgttgctgttaccgcctgtccgaccgggatcgcccatacgtatatggcagaagattcgttgaagaaaaaagcggaagaaatgggcattccgatccgggtggaaacaaacggctcggaaggtgttaagcacgaactgacaaaagatgaaatcaaccgtgctgtcggggtcattgtcgcagccgataagaaagttgaaatggcgcgctttaacggcaaacgcgtgctgcaaacgcctgtcagcgatgccatccgcaagccggaagatttgatcaaccgggtactggaacagcatgcgcctgtttaccatgcagacagcacggaccgcagcaatgacgatgagccggcagagaaaaagtcggtatggggaaccatttacaaagatttgatgaacgggatttcgcacatgctgccattcgttgttggcggcgggattttgcttgcgatttcgttcctgattgaaagaacagctggtgaacataacacgatttttaaaatgctgagtgcgattgcaggcggcgatacaggggcattccacttcttgattgcgattcttgccgggtttatcgcatcgagcattggtgaccgcccagcactcatgcctggtatggtcggcggctatcttgcgtctagctcgaatgccggtttcctcggtggtctcgcagctggtttccttgctgggtatattatcgtctttttgaaaaaagtatttgcagggctgccacaggcgctgaatggattaaagccgattttgattttcccggttttaggcctcctgattaccggcggattgatgtactatatttttgacccgattttcaaatggatcaacaccggtctaatcggtggtttgaataaccttggcacgggcaatgctgtcctgcttggtatcgttctgggcggcatgatggccatcgatatgggcggcccgttcaacaaagcggcttacacgtttgcgatcggggtatttacttcgagcggcaacacgaacggcctgatgatggctgctgtaatggccggtgggatggttccaccgcttgcgattgcgcttgccaccacgttcttcagaaataaatttacggatcaggaaaaagaagcaggcattacaaactatgtgctcgggctgtcctttattacagaaggggcgatcccgtttgcggcatccgatccgctccgtgtccttggttcaagcattgttggttcggcgatagccggcgggctgacgcaattctggcatattaacataccggctccgcacggcgggattttcgttgtattccttgccaaccatgcaatcttgttccttgtctccattattattggtgccattgtttccggcctgattctcgggatgtggaaacggcctgttgcacagaaaaacggttaatgcagtgaaagatattttggatataaagttaattggaaagcgaaaaaagaccggtatttctgaccggtctttttttaatttctgacattttttaacaggtccggccaaatcgcttgtactggtgctgacttccgttgcgaaaacaggttcacccattgtttcgtccattttctgcttcagcagggcaaaagattgaagcaacggccggtccgcgttaacataaaatcatcaagatattgccatcttcgccaaaaaatttcggtacagctcgtttttttacacgctttttacggatatttgggtatagttgtattagtggatttattagacataagacaaagagaataaggggaaattattccatatgaacatgtttctgattttattgatcttacttttacttgttggcatctccgacattttaaatcattttatcccatttattccggtgccgcttattcaaattgcactcgggcttgcgttcgcagccgtgccggtcggggcgcatgttccgcttcaaccggaattgtttttcgtgttatttattgcgccactgttgtttcatgatggaagaaatgtatcccgcgaagcgatgtggagactgcgaaatccgattttgctgcttgcgctcgggcttgtttttgtgacggtgtttgcggtcgggtatattacccatctgatgattccctcactcccgcttgcggccgcatttgccctggccgccattctatccccgaccgatgttgtagcggtcagcgccatctccgagcgggtaaaaatttcgcgcgtgatcatgaacctgctgcagggagaagggctgttaaatgatgcatccagccttgttgcatttaaatttgcgattgcggcagcggtcaccgggtcgttttcgcttgctgaagccagtggcagttttttgctcatctcgatcggcggctttttaggcggggcattgctggcatttttcattatccgcttcagggtgctgattcgccgcctcgggatggaagatgtcacggtccatatgctcatccaaattttaactccgtttttcatttaccttactgcggaacattttcatttatccggcattttggcggttgtcgccggcggaatggtccatgctgttgagcgtgaacgggaacagtcgccgaatttttcctaccagatcgtttcgcgcagcacgtggacggttttagcctatattttaaacggccttgtcttcgtccttttgggccagcaaatgccggctgtactcggcgaaatttggacaagctcggcttttaataacggcacggtgattttgtatatcattgtggtcacggccgcccttttgctgctccggtttctctgggtgtacgccgtgtggtgggccggatggaaatcaaaaaaacagcgccttgcaaagccttccctaaagcatacggcgattacaacgatatctggcgtccggggggcggtcacgctggccggcgcattctctattccgtacaccattgcaagcggagcgccttttccagaacgttctttgctgatttttattgcggccggtgtcatcctgctgacgcttgtgatcgcaagtgtgttcctgccgcttttggcgaggcgggaaggaaatgaggcggaccgttcagaacggaaagcggaaaaaaatgcttcaatctttatcggggaagcggcaatccagtctgtgcgtgaggaagtgaatgacgagaaccgggaagcggcagcggctgtgattgacaactatcaaaatatgctgcatcaattgaaagcggaagaaagtgaaatagattcacttgaattcaaacggattgaaacggagaccaggatgaaggcactggaggcggaaacagaatatattaatgctttgatgaaatcaaaacgcattgaccaagagatggcttttttgttccttgaatatattcaccggatggaaattgccgttaccgataaaatgaagttcaggtttttgaatttatggacccttttccggaaaggcgcccccaggtttcttttcctcttttacccgaataaggaaaaacgccgcaaacagcggattaaccgctatgcgaaaatcagacaaattaaaattgaaatggcggaagcggcgatccgggccattaaatctgggatgacagaggaaaacagggaaatttcgtttctagtcattagcgaataccggaagtttatcagaattttgagcaggccgaaaaatatggaggcatctctgaagtatacccagatggaaagggagctgcaggaaaaggcttttcaggccgaacgaaacgctgtacaggcgctgtttgaacgggggaaaatttcaagggagacggcccgcaaactccgcaagcaaatcaatatccgggaagtgtattggatggaagaacatcaactccatgcatgatataatcatcttagaagcctgtgccggaacgattgcggcatccgggagcctttcaggactgacctttgtaccgctttttccgcacacgggctggtataaaatggcgtaatctggccgcttctattgttaacccggcgtcattttgtatagtgaacatgatccaggattgaaagcctcgttgtattttccgtatttcaaaaaaagatgaatcggggtgcctgcaatgtatttaaccattcaggaaacagcggaatatctgtcttttccggaaccggtgattgaaaaattgatcttgcaaagacgcatacgcgccgtgcatgatggagaacagtatttgattaaccgggatcagtttgatatctatttgcaacagctcgaaaaatacaggcaacttgtggaagaatggctgaatgaaccgcttccggaagatccggacatcaaagacgaggactaaacggatattggaggatttggaatgtttgatatggtaaaaggaaagctgattgtgtcatgccaggcgctggaggatgaacctttgcacagtccgttcatcatgtcgaaaatggcgcttgcagcaaaagaaggcggagcggccggcattcgggcaaacagcgctgaagatatccgggccatcaaagcggaaacagggctgcctgttatcggcattgtcaaaagggattatgaaggttcggaagtgtatattactccaacaaaaaaagaaattgacgaactgcttgccgtaaaaccggatatgatcgcgcttgacgcgaccggccggaaacgcccgggcggcgaaacgctttccggtttaatcggatatatccatgaagccggtctcccggtgatggccgatatttccacagaggaagaaggattgcaggcagcaaggctcggtgcggattgcgtttccacgacgctttccggctacacctcctattctccgaaacagggagagcccgattttgcgttgctcaagaagcttgtggacgctttaacgattcccgtttttgcagaagggcatattgatacgccggctgaagcgaaaaaagcgctcgaattcggggcgtttgcagttgtggtgggttcagccattacaaggccgcagctgattacaaaaaaattcgcagaggcgatgaggtcataaaaagcttaatgaaaatgctgggtaagcagcagaagcggcttctataaggaatgtaaaccgatacaggaagatatggctctcatacgaaaggtgaagtgaaaaatggaagaatcatctatatcaaagcggaaagcggaacatatccgcgttgtgcttgaggaaaatgttgccgggaaagacaccacaaccggctttgaaaaatatcgttttgagcatcaggcgctgcctgaactagattttgaagaaatctcgacggaaacgacttttctcggtaagccgttgaaagccccgtttttgatcagctccatgaccggtggcactgctcaggcccgcaccattaaccggaacctggcgcaggcggcggagaaaagaggctgggcgtttgcgttagggtcaacacgggctgcgttagaaagcccggaacaggcgtatacgtttcaagtgcgggatgtcgcgccgcatattccggttttggccaacctcggtgccgtccagttgaattatggctacggaattgacgagtgccgccggatcgtggaactgaccggggcggatgctttaatcctgcatttcaactccttacaggaagtctttcaaaaaggcggcaatacgaattttaaagatctgcttgtgaaaattgaagacctttgcagccgcctagaagtgccggtcggctgcaaggaagtcgggtggggcatcaacggccgcctcgccgaaaagctttattccgttggcgtttcttttgtcgatgttgccggctcaggcgggacatcatggagccaggtggaaaaatatttaacgtccgatccgttgaaaaaagcggcagcagaggcattttccggctggggaaacccgacggcggcgtgcatcacccaagcccgcaaccttggccttcaaggtactttggtcgcaagcggcggcttgaaaaacggagtggatgccgccaaagctatcgccctcggagctgacttggcgggatttggaagaaagctgttgcatgatgccgtccattcagtggatgcactgctttctacttatgaacaaacagagcttgagctgaagattgcaatgttcggaatcggggcaaaagacttgtccgctttgaaacaaacaccgcttttgaaaaaaatgtaaataatggcctggtttggacgcgtgccggtttggattgataagcttgacgaaacaaatagatgggctagaaaaatctatcaagacaaccccgctgcttagaaatttgaagccggctggcccggaagtttcgggcggaaaaatatttgtttagaaattttaaccgttttcgccaaatgtaaacgccggttatttaagccggggccgcggtgaaataatcataaaaatatttgtttggaaattgtaatcgattttgacaaatgtatgcgccggctggagacgagaattcacccgggtaaaatggccatcaaaataatttgattagaaattttacctgtcttttccagttgaaagcgccagatgttttagacctgtggagacatgagtataaaaaacacggtccggaaattttaccgcggtgaaatgatcataaaattatttgtttggaaactcgaaccagctttgtagatgtaaacgcgggatattttaagccggcgggaggcgagaatttcacctggttttggaaattttaaccgcctttggcagatgtaaacgttgtatgttttagaccggtggagacacgagtataaaagtcccggtcaggaatgtgaaccggctgcataaaaaaccccggctcccgtttttgggaggccgggattttttattttttcgcgcctgcaaaatttgacagttggttcatcagtttgctgcgtgatcttttattccgcaacaagtaggcagcacctaaagcgactgctgtcatggccatcgattttttcatgatccaccacatcccttcttttttcgtatgtttgtacttttccccttgcatgcggaattaaacagtttaaagccaaaatgaaaaagcaaacccgcaaaaggtttgctttaatatgaaccggttaatgggcaggacgtggtttatgggcccggttttggaaataattttttattgccgggatggcgatacggtcaagtccccagtagtaagatgcactgcctgtaaacagcagaatgatggcgacggtgtaaaggaccgggttggtgctcgttgtgccggcaagcataaagttcaggttcataaacgcgcctgcaattaaagccgggatggttgccagcccgacgatcaggccgaggccaaccagtacttccccataagggatcagcacattaaaaacatggacattcggtatggcaaaatgggtgaggaacgctgcgtaccagccttgaacttcggcattttcgccagccgtttttgccagtgccccctttaaaaatccagcagcatcaaaccctcccgtcaatttatgcaaacctgcttcaagccattgaatgccgagccaaatacggatgattgcccagataatgctgactttggaatcatgataccatttcatttttaacatctcccttaggataaatgatgataacatgtgaatttcttcacatatcttacatttttagaatacagcgtttgcaacggaattacaatggattccggacagttgtcaagaatttgtgatatatttcacatttgtgaacaaaacattaaaaaagcggcaagccaagcttaccgctttgattcgtttccttccctttccattcgcaaaccgcttacccaaggtccgttgccgttttgatcatgctccggttccttattttaccggatttccaaaacttccttcgaaaaccgattctttcacaggcctgcgtgcagaaggcgtctctctttcctgcagggaaggaggcagcgcctctttttcaccctggtatccgatggcaataagggcatcaattgcataatcagccgggatgttcaatacttcacgtgctttttcaaaatcaaagcctgtcatcggatgcgtagcgagcccttttctgacggcttcaagggagaggtatccccacgcggcccctgcatcaaaagcatgcgaacggatcgggccggtttcattttctgttttcgagagaataagcgcaaaaacggggacgttcttgcaccacatccggttgtattccccgagaaacgacagaactttttccctgtcttcctttgtacgtgcaagaataaagcgccaaggctgatggttataagcggacggcgcccagcgtgctgcttcaaacaggctcaaaagcacctcttccggtacttctttttccaaaaaagaacgcggtgaccatctttccaaatagactggatcgatatcatattgcgcttcccgcggcgataatgtttttaccatggggactcctccttattgatgtcgtatcttttttatattaaaatacttcaactcgatctacaaacgattcaactcggacgaaaaatgtatttgtgcacctatatattgtataatagacctaggagaaaatacgaacaggatgatctgaattggttgattatttgcttttcgaagaagatgtcgagatgatgtattcccctgctattttccatcggggaatgagttattatatgcagggccgggtcaaaaaattgatttttaataaagactccacctggacggcaatcgtaaaagggtccaaaacctattacgtcactatttactatgacgaagaattcggggaattttcaaacgtatgtacatgcccggcacatgaacaatacggcgagtgcaagcatgaagtagcggccatgcttgcgattgcaaatggggaggaagaggcggcagaaccgaatattggcgatgtttcggagacgcaccagcatatgaaaactttacaattgatgaatattttttccggccttcaacaaagcatgatggaaacaaaacacaatgccgcgagaaagccactccgtcttgaatattttttaaaagctacgaacgtttccggctttggctctgaccactttttaaccattgaaattaaaatcgggcccggccggacatatgtggtccgcgacataaaagatttcctcggcaatgtcagccgcgggaacccgcatgcatttacaaaaaacttcatttatgatccggatgaacatgcgttcgaagaagaagataaggaaattgtggagatgctgctttatatgctgtccacccagcaattgtacgaggcttccatggatcgttggtacagatttgcattggagcgggaactggtcattccgccgtttatcgcaaggccacttataaagaaactggcaaaccgcaaatgcaaattcaaatatgaacgttacgcggcagattcgattgtcttgcatcaggaagaagaactaccgctttctttccggcttgacggcaataggcaagacggtccgggctttttactgcagctgaagagcttaaaggatttgcttttatttgaacaatacgggcttgcattttacaaagggggattttatgagctgtccccggaccagcttacccttttagcggcacttgaagatttttacaagaaaagtggcgatgaagtagaggtccagcaagagcagatgagcccgttcctttccaatgtgctgccgggcctaaagcggatcggcaaagtaaggctcgcaaatgaaatcaaagggaaaatcgtccagccaaaactgcaaacgaaaatttttatggacaacgaagacgaaaagattacgctgcggattgaacatcattacggatcccgtgtcattgatccgtttacggacgaagaaacgccggatgatgataagattttgctacgcgatgtggaaaaagagcagaaaatcatgatgatgatcgagcagtcgccgctcaaatataacggcaaacagctgtatttggaagacgatgaagaagcgctgtacgaatttatttttacgattctaccgcagcttgaagaagaagtggaagtgtatattgcaggcggcatcaaatcgtatttccagacgagccgctacacgccggttacatcggtggatatggatacgagcggaaattttctggaagtcaattttgacatggatgggattgatgaagaagaaatccgcaatgtgctccggtccgtaatcgagaaaaaacggtattaccggctaccggacggggcttttgtctcccttgaaagcgatgcattcgaacatatcgggcagcttctcgaagaactgcatgtcccgaagaaagagcttgaagacaaccgcctgaaagttccgctttaccgcgggctccaggtggaagagctgatgaagacgcgtgataaatatgctgttaaattcggcaaagcgttccggaagctcgtccagcagctgaaaaatccggaagatacggatttcgaactgccaaaagggcttgaggcaaagatgcgtgattatcaggtgaccgggtttcaatggttcaagtcgctcgccttttaccgtcttggcgggattctggctgatgacatggggctcgggaaaacattgcagagcatctcttacatgttatcagaaaaagaagcgaatccggatatcaagccgtttttggttgtggcgccggcatcccttatttacaattggaaaagcgagattgaaaaatttgcaccggggctgtcgtcgatggttattgccggcacgccttccgagcggaaagccttttttgaagcgggcgagctgccggatgtgttgatcacctcgtacccgacgctgcgccaggatatcgaggagtacgaaaagattgaattcgatactttgattttggatgaggcccaggcgattaaaaactatgcgacaaaaacagccgccgccgtccggaatgtgcaggcggggagaagatttgcgttgagcggcacgccaattgaaaattccattgatgagctatggtcgatttttcaggcggttctcccgggctttttcccgccgctgcctgaattccggaaaatggagcaggaaaaaatttcgcggatggtgcggccgtttattctgcggcgcgtcaaaaaagatgtattgaaggagctgccggataaaattgaaaccaatcatttgtccgagctgacgaaaccgcaaaaagagctttatctggcgtatttggacagaatccggcatgaaacagcccaaacgctggctgaaggggattttaaccggaaccggattaagattctggcggggcttacccgtctgcgccaattgtgctgccatccgtcgctgtttgtggaaaattaccggggcgactccgggaaacttgagcagctcgttgaattggcgcatacggcgattgaaaacgggaagcggctgctgattttttcgcagttttccagcatgctccagatgatccggacgcggctttctgacgagggcatcgattctttttatcttgatggccagacgccgtcacgggagcgggtcgaaatggcagaccggtttaacagcggcgagaaaaatgtctttttgatttcgctcaaggccggtggtaccggcttaaacctgaccggcgccgatactgttgtgctgtatgatttgtggtggaacccggctgttgaagaacaggcagccggccgcgcccaccgcatcggccagaaaaacgttgtccaggtcatccgcctgatcgcccgcggcaccatcgaggaaaaaatatacgaactccagcagaaaaagaaagaactgatcgaacaagtcatccagccgggcgaaaccatgctgaacagcctgaatgaagaggaaattaaagaactgctaggcatgtaaagaaaatgctgatgcgtttgcatttacggcctggtggggaccggtatgtaaggaggctttgaacattcaaagatcggcatttttgaaaattaaaagcagctggccgagaattgaaacttcgggactttcagcaaggatagcaaggatgcttcaggtttcccgattacgggaagcctttgctgacgccctaaacaaagttttcgcagctttcagcaaggatgcttcaggcctcccgattgcgaggctttcccttccccgggagatggctgggtgtataaaagagaatttgcgcatacctggttggagctttcccagcctggtggcgaccgatatgtaagaaaaccccccgcggttatttggctgcggggggtttttgggatgggaggggcggttaataaatggaaatttttatttttattcaaaaagtaattccgattattgttatataatggaggatgaaaggaggaaaatcatggagtacattgcgcatattcgggaaagcgacaagaaggtacagacagttgaagaacacttattggcagcaaaggaattagctgaaacttatggagaaaagattggtgtgaagcacataaccgggcttgctgctctgcttcacgatctggggaaatatacaagtgcattccgcaattatgttttggaagcggtaaacaaccctgatcatccgccaaaaagaggaagcgtagaccattctaccgccggaggaaagcttttattcaaaatgttccattcaggaaaagccagccctcataaagcattattagctgaaattgtgggtaatgcaatcatttctcaccattcttatttgcaggattttatcagcccggaaatggacctaaagtatttaaacagagttgatagtaaggaaattgacgaatttgaaacggcaaaagaaaatttctttgaaaaagtcatgagcccaacacgcttttccagttatgtaaatcaggctgaaattgaattgaagaactttattatgaaagacgcatcgaaaacgctcacacataagatgatgtttttaacgaagtatattttcagtgcattaattgatgctgaccggacgaatacgagattgtttgaggaaaataaaccagaaaaagaacaattttcggtttcaaagttgtttaatcaatactatgaaaaactgttacttactttagacagttataaggaaaactcgagcgctaatgcccgtatcaatcgattaagatccgaaatgtccgagcaatgcgatgcctttgccgagaaaccgtctggtatttatacgctttcgatcccgacaggaggaggaaaaacttttgccagcctgcgatacgcattaaaacatgcccaactttataacaaaaagcgtatcatttatatcgtgccttttacaacaattatcgaacaaaatgctgaggaagtgcggaaagttttgcaagacgatgtaaatattcttgagcatcattcaaatgtcgtcgaagatgctgatgagaatgatgaacaacaggacggaataatgagtgtgcagcaaagactgaaacttgcaaaggataattgggatgttccgatcatttttaccacgatggtgcaatttttaaatgtattttatgcgaagggaagtagaaatattagacgccttcacaatatgagtgaagcggtgctaatctttgatgaagtgcaaaaagttccggtgccttgcatttccttattcaatgaagcactaaattttttaaaaacatattgccattccagcattctgctttgtacggcaacccagccggcattaaattatgttgaacatcaattacaggtcagcccaaatccggagattatccgtggtctggataacgtaatagacgcctttaaaagagttgaaattgttgacagggcaactgatgaaacctttaacaccgaaaagcttgcaaactttattgagaaaagaatgacggaggtttccagtgttctggttatattgaataccaagggtgttgtaaaaaaattatatgaacatttaaattcaaacgataataatatcaacattttccatttaagtacgtctatgtgtgcagcccaccgtaatcaaattttagaagaggtaaggcactgtctggatgccggtaaaaaagtaatatgtgtaagcacccaattaattgaggcgggtgttgatgtgagcttcgagtgtgtcatccgttccttagccggtctggattcaattgcacaggcggcaggacgttgcaatcggcatggagagaaagagaccggttttgtatatgtgatcaaccatgaagaagaaaatttaagcaggcttccggaaataaaaaagggaaaagagacttcaaagcgaatttttatcgatttaaaaaatacaccatctatctataatggaaatgttctgtctatccaagcaatggaaaaatattttaaagagttttatacagcgtttgatgcaaatttagattacaatgttccgtctcttcagaagaatatggtggaaatgttaacaactgatcccaacaactatagttatgtgagggcttattgcagtaatacgaaaaagaagtatcccttgttcttaagcagcagtttttatacagctgcagaaaaatttcgtgtgatagatgataagacaacttccgttattgttccatttgggaaaggaaatgacgtaatagccgaattaagcagcaacgcaaccattgaagatctcagcaaactcatgaaaaaggcacaacagtacactattaacctttacagccaggaacttggaaagcttgaaagaaatggcggaatcataagtttgtttgacggtaaaatattggctctcaaagaaggtgcatatgatcatgaattcggtttgaatgtggagaatgacagcgaattggattttttgtcaatttaaaaacctatcataacagataggtttttaaatcatataatatatatttcaatccgcgctttaccagcgactatattatcataacacaaaaagggaaagaaaaattttttcatataatatataattaattattgacttaaaaaaaggcacattgtatactgaatttatcaaaacagccaaaaaatgagaggaggggaaaaatgaggaattctattgaatttgaggtatatggcaaatatgctttgtttactgatccgttgacaaaaatgggaggtgaaaaattatcctaccaaataccgacctaccaagcgctaaaggggatagtcgaatcgatctactggaaacctactattctaatgataattgatgatttgcgtgtgatgaatcctatcaagatggagtctaagggtgtcaggccgattgaatacaacggcggcaatacactggcaaattacacatatttgcgtgatgtgcgttacaaagtgagggctcatttcatctttaacccacacaggccggatttggcatttgatcgtaacgaacataagcatcataatattctgaaacgatccttgaaagctggcggaagaagagacattttccttggcgcccgggagtgccagggttatgtggaaccctgtgtattcgaggaaggtgagggttactatgaccaaacagaagaagtgtattttggaacaatggttcacggcataaattatccagatgaaaccggccgtaatgaaatggaagtcagattgtggaaccctgttatgaaaaacggcgtgattcattttatccggccggacgagtgtaaactggtgagaagagttgcagaaatggaaatgaaagcctttaccaaggataatgtggagtctgccgatgtgcttttaaaagaactagagaggggaggggaattgtgagtgagctggttactaaacttatatgagacttatcaagcgaatgaagagcaggtcgggaaaattgaaaagaaaagaaatgatcaggagtacacgcttcttccggtttcacataccacacaaactgcacatttagaagtgcaggtaacggaggatggaaatttttattatgcggaggtaattaatgataaaaaggatgcggttacattaatcccgtgcacagaagaatcatccagccgtgccggtaaaaaaatagctccttacccattgcatgataaattgatttatgtagccggcgactttgtggcttatggaggaaaaatagaagagcctttctcttattatattcaacaattaggtgagtgggcaaattctccgtttagtaatgcgaaagtgcagagtatctatgcatatttaaaaaagaaacagttaatccacgatcttgtagaagcgggaattttgtttttggataacaacgggcagttaattgataaatgggacagtaagtatggtgataagcctccattatattcaacagttacagggagtgttgagagcacttttgtaaggtttactgtttattcgcctgaaaaaatcctgaccaaagtatggaaagatccggaaatgtacgaatcatttataaaattttacaatcaacatttaagtgaccgggatctttgttatgtaacgggtgaatttttgccaagcacagagaggcatgctaataaaatcagaaattccggagataaagccaaactgatatctgcgaatgactcaagagggtttacgtacagaggaagatttactgaaagcaaacaagtggcaagtattagttataaagcatcgcaaaaagctcataatgcgctgaaatggttgatcaacaagcagggaaaaataatcgataacagagtatttcttgtatgggaaaacggcggaaatgaagtgccgtcggtcaccgaagattcatatgacattaccagtcttgatccttttgcaaatgggagcaatccaaaaatagcttttacaaaccaggaatttgcacgtgaattttctaaggcaatggatggatataaaagcaatctttcgactgaagccagtattaatattttggttttagattcggcaacaaccggaagaatggctgtcctttattatcgaaatttaaataaagagatttattttaaaaatttagtaaaatggcatacaacttgtgcctggctccaccgttatcgaaaaaatgaggacaaccaaccgatttcatttttcggtgcaccttcgacgaaagatatcgcgttcgcagcgtatggtccaaatgcaagtgataaagttgtaaagggcttaatggaaagaatgcttccgtgtattgtggaagggagaagaatcccaacagatattgtcagaagtgcccttcggcgtgcatctaatccggtcgctttggaaaaatgggaatgggaaaaaacattaagcattgcttgtgcacttattaataaagaggagggatataatttggcacttgataaagaaaataccaaccgcgattatttattcggaaggttgctcgcaattgcggatgtactcgaacgaaatgctttggattccggcgaaaatcgtgctaccaatgccatccgatatatgaatgcattttcacagcatcctgcacgaacttggggaacgattcaggccagtttgcagccatatcaagtccgtctggggaaaaaagggacgtactacgccatgttaatagatgaagtcgcttctaaacttaaatatgaagattttaatgacaggcctttatcgggtaagtttttgcttggcttttatagccagcgctatgatttatatcagaagaaagataccagtactgttggacaaactaaagaataaaagattgagaggggactaattatgccagctttagatcataagattgattttgccgttgtgttgtctgttacaaaagctaatcccaatggagatccgttgaacggaaaccgcccgcgccaaaattatgatggttacggggaaatttctgatgttgcgattaaacgcaaaatcagaaaccgtctacaagacatgggcgaatcaatttttgtgcaatcaaacgatcgaaaaaatgattcgtacaacagtttaaaagaacgggcggatgcgaatccggaattgaataagatttttaagtccaaagacggatcaggtgaaacttttgctgctatcgcatgccaagagtggattgatgtccgcagtttcggccaagtatttgcatttaaaggatccggcaataaaggtgtatctgtaggggtaagaggccctgtttcaatccatactgctaccagtgtatccccaattgatattacaagcatgcaaattaccaaaagtgtaaactctgagcctggtaaagaccggggttccgacactatgggaatgaaacaccgcgtagactttggtgtctatgtattttatggaagtatcaatccacagttggccgaaaaaacaggattttcaaatgaggatgccgagaaaattaagcaggccttggtcacgttatttgaaaatgatgcttcttctgcacgtcctgaagggagcatggaagtcaaaaaagtatattggtgggaacaccagtccaaattgggccagtattcgtcggcgaaagtgcatcggtcattagctgttacaccacttgtggataatcctaaaacgtttgaggactatgaaattactttaaatgaattgagcggtttaaaggttgacgtcatcgatggcatttgatgaagatgaatacttaatgttgtcgggtattcaacattttcaattttgcaagcggcaatgggcattgattcatatagagcaagcgtgggaagaaaatgtaagaacggttgaggggcaaaatatccatcaaaaaacggatagcccctttatccgtgaaaagcgaggtagtaaattaattgtccgggcaatgccaattaaatcaaatgaattgaaattgactggaatatgtgatgttgttgaatttgtgaaggataagaatggcgttgaaatttatgggaatgaaggaaaatatattccttatccggttgaatacaaacgcggcaaaccgaaaaagaatgattcggatattttacagcttgttgcgcaggcgatgtgtcttgaggaaatgcttctatgtgaggttaacaagggctatattttttataacgaaatcaaacgccggattgaaattccgataaccttggatgaaaaaaataaagttagaaagattgctgctgagatgcaagattactatcaacgccgttatacgccaaaagtaaaaaccggccccttctgcaaccaatgttccctccagaatatttgtttgccgaatatcattcgtaaacgtgctgtttccagttatatagaagggaagataaatgagtgaaaaaactcctgaacactttatttattacgcagccggaagtttatttatccttggatggagacaatattgtgcttttaaaagagaaggaacaattggggcgactgccactgcacaatttggaatcggtcgttgcttttggctatacaggggccagccctgccttaatggggtattgcgccgaaaggaatatttctctcattttctttacaatgaatggccgctttcttgccagagtaattggtaaaagcaggggaaatgttgttttgcgaaaaaaacaataccgtatctcagatgatgaaatcgcttcggttcaaattgccaggaattttattatcgggaagatatacaaccaaaaatggattcttgaaagaatgacaagagattatccgttgcgtattgatgttacgcaatttaaggatgtttcccggtttttatccgccattatcaaacaggtcagactatgcgatagtttagaaacattgagggggttagaaggacaggctgccatcaattacaataaattatttgaccaaatgattctacagcaaaaagatgattttttctttcatcaccgttcacgccggccgcctttggataacgtgaacgccatgttgtcctttgcttatacattactggcaaatgacacagcttccgcactggaaggagtaggtcttgatgcctatgttggatttatgcaccaagacagaccgggcagggtttcacttgctctggacttaatggaagaattaagaggtgtgtatgcggaccgttttgtactttcattaatcaataccaaggtaatcaataaagatgattttttaaaaaaggaaaatggaaccgtcattatgacagatgaagcaagaaaaaagtttctaaaagcctggcaaaataaaaaacaggaaaagattactcatccgtttcttggagaaaagatttcatggggactggttccccatgcacaagctctgttgttggcccggtttttaagaggagatttagatgagtatcctccttttctgtggaagtaggtggaaaattttgcttgttgtcattacttatgatgtgagtactttgaccggagcagggcagaagaggttaagaaaagtagcgaaagtttgtcaaaactatggccagcgtgtccagaattccgtttttgagtgtttcgttgatgcaacacaatttgcctctttgaagattgaactgtctaatattattgacccagatgaagatagcctgagattttatcagttgggaaacaactataaaaataaagtaatgcatatcggggcaaaaccatctttggatttagaagaccccttgatcttttagtgcgaaggtgtagtgcacacgattttcccgtgtgttcgcaccaatatgctaaccaatattttacatatattggttaaatgtggaaaaatagtcctttgtttatcagaggaaatggcgaaatttggttgttttaaaaacgtacattcgcctttttgaccaaattccgctgtcgctccctacatgggggcgtggattgaaatcgccgacaaatacaaatgaatttcactcgtcaacgtcgctccctacatgggggcgtggattgaaatatcaagcggaaagcacgttggcaaatgggcggtgtcgctccctacatgggggcgtggattgaaattggaacagttaacgtcagacaatttacagggctgtcgctccctacatgggggcgtggattgaaatccaaacgatcagggataaagtatgggatgagtgggtcgctccctacatgggggcgtggattgaaatatctaattcaactaatgaaccgtcatcgtatctgctgtcgctccctacatgggggcgtggattgaaatttcccgctgctggttgatcagctttttctgttctgtcgctccctacatgggggcgtggattgaaatagacgacaaatacgacttactttggtacaagttatgtcgctccctacatgggggcgtggattgaaattacatctggcacatacacgttaaagctggacgagcgtcgctccctacatgggggcgtggattgaaatcgggtcaaaatccaaaaggtttaaagcatcgctagtcgctccctacatgggggcgtggattgaaatttctagcgttataaccgggcggtctggcattttgccgtcgctccctacatgggggcgtggattgaaatcgcgctatgctactggaatagggacattgccacgtcgctccctacatgggggcgtggattgaaatctaaaccgtgacaagcaaaatccgaaacacgacaagtcgctccctacatgggggcgtggattgaaatccaagctcgatataataatcagcaaaagcctgctgtcgctccctacatgggggcgtggattgaaatgtagacaatgcgttgtaattccgagtcaaaaagtgtcgctccctacatgggggcgtggattgaaatgaacttaacgacggaatcgaactcgacagcgacggtcgctccctacatgggggcgtggattgaaatgcaccatgctcatcgggcaaaggaaaacatcctgtcgctccctacatgggggcgtggattgaaatgttgcagaacaaggctttgatggcatcgattatagtcgctccctacatgggggcgtggattgaaatccgtcatcaattttgcaccggattgtgcatcctggtcgctccctacatgggggcgtggattgaaataggcagatcacccggatcttttggaccgggaaatgtcgctccctacatgggggcgtggattgaaatagttaaaaattgtcggtttttgccgtccgtatcgtcgctccctacatgggggcgtggattgaaattatgcgcagctggcctgtctctaccgcctgcattgtcgctccctacatgggggcgtggattgaaatatcaagccactcaggcgggttcacatgcgcggcacgtcgctccctacatgggggcgtggattgaaatgccactaccaccacattccgggtcaatgaatgggtcgtcgctccctacatgggggcgtggattgaaattgatcaatggtgctcactctataaaatcactcggtcgctccctacatgggggcgtggattgaaatgggtcgctacagctaaaagtaagtgtgcatttcggtcgctccctacatgggggcgtggattgaaatttggatatcgtattttgcgatgtatgcggccaccggtcgctccctacatgggggcgtggattgaaatgcctttgcttgcaggtcctggacaatttccggcgtcgctccctacatgggggcgtggattgaaattgatcaatggtgctcactctataaaatcactcggtcgctccctacatgggggcgtggattgaaatacgttgcagccagtcgccgattgcggtcccctgcggtcgctccctacatgggggcgtggattgaaatatcaagccactcaggcgggttcacatgcgcggcacgtcgctccctacatgggggcgtggattgaaattttctttgccattttttcattcctccttgttgttgtcgctccctacatgggggcgtggattgaaatgccactaccaccacattccgggtcaatgaatgggtcgtcgctccctacatgggggcgtggattgaaattgatcaatggtgctcactctataaaatcactcggtcgctccctacatgggggcgtggattgaaatgccagtacatcggtcacgtcggttatgacgtctatcgtcgctccctacatgggggcgtggattgaaataagacgcctaccagttaattgcggtcgatacggagtcgctccctacatgggggcgtggattgaaatctgtttgaatgcacgggactgactgaatactgggtcgctccctacatgggggcgtggattgaaatcggtgcatccttgagtgcttcaatatggtgcacgtcgctccctacatgggggcgtggattgaaattgccggaggacctggatacagctatccagcattagtcgctccctacatgggggcgtggattgaaattgcaatggcagggagccttaatctttcccactttgtcgctccctacatgggggcgtggattgaaatcattcctccatgctccaccccgtccacgcttgtagtcgctccctacatgggggcgtggattgaaatctttaaatacgcggaaacatccccatagtttgcaggtcgctccctacatgggggcgtggattgaaatctcctccaatatgtatagatcgtcaaccttcacccgtcgctccctacatgggggcgtggattgaaatcgtttgctgtatttgcgatccctaggatcatcaagtcgctccctaatgaatacttgctgagcaaaccagacaaagccttgtatctggttcgctcagccgcaaatctggttgatgccgccttctttgttccttccatcaaccttagacccgaaaagtggcgctgaacgcgcagataccagtgacaaaccctttttgtaaagtaactcttgtttttatagttcctggaaccgggaccagggctttccttattcagcagcccccgattatgtatttctgtcatcctcgtcgtccagttccctgatcaaattccaagtctgataaatccggtttgccattttctcaggatctttcagcatcatttggtataaatccggctcatggctcaacgtttcaagcagtttcttttccggattactgaccgcttcatttgtcttcaggccggcatggttggtaaggcccaaaagataatcaattgaaactttcaacacttgcgaaattcggtatagcaccttaatagaaggaaaactgtatccagtttcgtagttcgaaatgttccggtcgcttaccccgacttttttcgcaagttcaggctggctgtagccttgagctgtccgcacttttttcaatcgggctgcgaatatttctttaacgttttccatgttttcattcccatgatcggccattgctactgctccttaaaaaaaatcaaaaaagatggttgacttccaaaataattgtgtataatataagtgtatagaaattattttgttgatgagcatctgtacaaaaagttgacaaagagccggagacacaaagaaaatagatgcttcagcaaaaaatacccccctattttctcataattcttacttactattcccaaattcaaagtaagagtaatatggtctccaggctctttttttacagtctcccttccagtttagcatgaaaacgatgctgttttaacccctttttaaattgtaaacgctttcattaaaatgacgggtctatttacccacccttccataacaccgttaacgacgctagtcccatactggcacgcaaaaggtttgctgaacgaattccattctggctttgcctcaatatatagaaggatgcctctgtcgcaaatgggggatgctaccttctctatacgttgaaccggcttatgcgggcaaagataagtccggataagcggtcagtctctttatcaagtccacggttcgtaaccccttcaagcaggcaggacagttccatgcctttataaaatcgacattccctgttttcctttacatgacgttcatgtccaccaaccttatcccaggtttagaggaaatcaattataaaaaagcattgtagcttacgttcaaaatgccccagccccaatatagcctctgcccatgcggttccattgttcaaccggcatgggcagggttctacagcataggtgcaactctcaattttttatggaagataagtgcgtattaagattaatggccagaaatccggcgttttccggtgtctctttataaatcgtaattccagtattgtcttgtgggatcatccggtaatttttatacgggacttcaagggttccggcgacgaaaaagcggattgccatgctgtgggcaacaacaaggacagtttcttccggatgtttctccaccagctcatcgatacaggcacggacacggttatagacctgaatggccgtttcccccgtataacctgcatgtgtcgcacccggatcttttagccaggcctcccaattatccgcatatttaacggaaaaatcttcctggcgttctccctcccaggcaccgaagtccgtttcgacaagacgtggatcttgatggattttcaaattccgcccctcaacgagaatttctgccgtacgggtagcccggcccaatgtggatgcataaacagcattaaacggaatgtcctttaaaaaccctgccgccagttccgcctgccgcacgccggtctgcgacaaaccgatatcgcttctcccgcaatatctgttccggtcggcattccattctgtctggccatggcgcacaaaataaaaaagtgtcataatgtaccccttttcacaaagtatcaactggttttattttaacaaattgaggagtggaatgctatttccggtcaataagattcctttcataatccatgagaagaacactctctagatgttcatttagctgtgtacatttaggtgatagagtgtcttctcattttttcactcattcgccgcttcaagtaaagttttacaaataccgaattgccggatatgcaacacgattgcgtccgagccctccctataaaaaatttatttgctatattatattaaaatattatataatgacaaaggacgctaaaacattgaagaaggatgagttgtttttttattttttaaaaacttcatatcatcgctcaattacatgtttatgtaaacgggggaaccaacaggtgttttatgcaccaggggtgaaacctttcaatgaaaggtagggaaactctttattccctaatccgtcagctaacctcgtaagcgtctggagagaactgtgtgtgttttttggacacgccttttaagcaaaaatgctgcgaaggaatttctctctttcgtggtttttttaattcacaaatttggttttcggggtaaagccggaaactggcaggacttgcgatttgagttttacaaacaatccggtatgcagcttgcgtactgcgctttttgaaaaatattggcatctgggagggaaacttcatgaaaagagtgagcttagcctggcagatttttatcggcctgatactaggtattgcgattggcggcattttccacggcaatgacaccgtggcccatattctccagccgtttggcgacttctttttgcgcttgattaaaatgattgtgattccgattgtcgtttcaagcttgattgtcggtgttgccggcgcaggcgatatgaaacaggttggaaagcttggcctgaaagcattgatttattttgaaattgtcacgaccatcgcgattgtagtaggactgctggccggaaacttgtttcatccggggacaggggtggatatgggctcattggcaaaaacatcgatcagcagctatgtggaaacaacaaaagagacgcaacacaatggcatagtcgatacgattttaagtatcgtgccgacgaacttgtttgaatccctttcacaagggaatatgcttccgatcattttcttctctgtcatgttcgggattggggtggcagccatcggggaaaaaggaaaaccggtgctccgctttttccagggtgtcagtgaagcaatgttttatgtcactaatttggtcatgaaagtggctccaattggtgtattcggcctgattggtgtaaccgttacacaattcggcctcaagtcattgattccgctaagcaaacttgttttcacggtttacggcacgattattttctttgtggttgtcgtgcttggcctgattgcctggcttttccgtgtaaatattttcaatctcttcaaaatcctgaaagacgaattgatccttgcttattccactgcaagctcggaagcggtgctgccaaggctcatggagaaaatggaaaaattcggttgcccgaaatcgatcactacactggtgattccgaccgggtactcattcaacctggacggctcgaccttgtaccagtcgctggcggcgctgtttattgcgcaaatgtacgggattcacatgtccatcggtgcgcaaatttcgctggtgcttgtgctgatggttacatcaaaaggcatcgccggtgttccaggagtttcattcgttgtccttttggcgacgctggggacggtcgggattccgcttgaaggcttagcatttattgctggcattgaccgtattctggatatggcaagaacagcctgcaatgtcgttggcaatacgcttgcaaccattattgtgtcaaaatgggaaggaaaatatgataaagaaaaagcagaagcgtaccttgccgaaatcagcggtggcgggcacgattccaaagatcacaaatatgtaacggaatcttaagatgagcgatgaagttaaaaaaggtgcactgccggaatagaggcagcgcgccttttttgtttgcgagtaaagaacgtcggtagttttttacatttccatcaaattatgctagctctgttgcctactggagtcatgatgcaaattggcgcttggactcggtgtgaaaacttcatccgtataagttgaactccttcttgatgtgtcgccagaagaaatgcttaccttgatcggctttgattttggagcggtacagatttttgtcgggaaaaattgtgcctctctttccaaggattgttaccggttggactgaaataatgagcgccctagggcacaaactattcacagcagcatgtattgattttttggagggataaagatggacaaaaaaatgctactgtgggtagcggtactgtccctcgctctttttccccggacggaacatgcggatgcggctttttggtttcaatcgaaacgggccactgtcgacttgcgtttgctggagacatcggatttgcacggctatatgctgaattatgattatgccgctcgcactgaggcggagacttatggtcttgctcttacggcttcactcattgcagcggagaggaagacggcaaaaaatacgatgctgtttgatgatggggacttacttgaagggaacgaaatggctgcttatgttgcccggcgcccgttaaaaaaaggggaaattcatccgtttatccgcgtgatgaatcatttaaattacgacgcagcgaccgtgggcaatcatgattttcattacggacttgattttttgaaacagacgatcaatggagcaaagtttccgtttgtaaatgccaatatatactataatttcgaaaaaaatgatacagatgaccaaaattttttcaaaccctatgtgattctggataaaaaagtggaagaccggagcgggcaccatcatcatctgaaaatcggggtcatcggatttgttacgccttcagtcattgaatgggaaaaaccgagccttggcggcaaagtcaaagcaaaggacatcctgcatacggctgcctggtttgtcccgcgaatgaaggcggaaggagccgacctgatcatcgcgcttgcccattgtggtgtggatccggctgcgaaacaaccgttttatacaggcgatgccgtatatttattaagcgaggtaaaagggatcgatgccattctgtttgggcatcagcatagggtgttcccaagcgaattttttgccggcgtccccggcgtcgatatccggaaagggacaatcaatggcgtgccagcagtaatgcccggcaagtgggggagtcatctcggtgtgatcagtctcactttggaaaaaaagggagagaagtgggagatgacgcaggcacaatcggaggcgaaaccggtatatgccatccacaatcaacaggcaaaatccatcgttagaccggatccggatattgttcgaatgaccgccgagctgcaaaaaaacgtgctggggtccaagtttactttatatagtcgaaactaatttgcccatgccgcctttgttgcggcatgggcattgaagtgaaggaagaggacggcggggcatattttaacgtagaggtgttctatgttaaggaagcacgtgaaagtctgcatctatcttaaagtagatgcgttctaagtgaaggcggggcatgaaaaattgtgtctatcttaacatagggacgctctatgttaaggaagctggagaaaaatcatgtctatcttaacatagatgcgttctaagtaaaggaagcacgtgaaaaccagcgtctatcttaacgtagatgcgttttaagtgaaggaagagcatgaaaaatcgtgtctatcttaacatagggacgttctatgttaaggaagcacgtgaaaatctgcatctatcttaaagtagatgcgttctaagtgaaggaggggcatgaaaaattgcgtctatcttaacatagggacgctctaaataaactttccgtacatggttaaaattgtcgcacctccccacactaggccctggttttctcatcatatttttagggaaaacggaaggtgcaatcgtgtataatagaaatgatgcatcatgatgagcaggtttgtaggcttttgaaatggcagcgcggcaagcccgcaacatttcaaaaagggaggaaaaaaagaatgctaaaaagattgggatggatctggttcatcgctatgattgcgcttgggttcaccatgaacggcgtggcaaaagcgtccggcgataacagtacagtgatcgatgaaaaatacgggaaaccgatcgttgcgacaggcgcggctctttctgcctcgcaaaaagcagaggtggaaaaggaacttggcgtggacgatgcaaacaatgtcgaagagattaccgtaaccggcgatgatcttgtccattacatccctgatggcaaccgcaattcgaatatgtattcatccgcaaaaattacaagaacggattccggcggtatccaggtgaatattgtaacaccggaaaatattacagaagtaacggcagatatgtataaaaatgcgctgctcactgctggaattaaaaatgcggaagtggaagtggcttccccgctcaaagtaaccggacattcagcgcttgtcggtatttataaagcttacgacaattcggataaatccggggataaacttaattcagaccggacggaagtggccagccaggaactgagtgttgcaacggatctggcgaaaaaggaagggttaagcaatgatcaagtgacccagcttcttacggaaattaagcaggaaattgcaaaccagcatccggcaacaaaagaagatattgaaaaaatcgttgatgataaattgaaggatttaaacatcaatttgagcgattccgaccgccagctgctgtatgatttattcgaccagatgcgtaagctcaacatcaattttggttcggtcaaaagcgaattgagttccttgtccgacaaactgagcgataagatcaacaaagcggccggagacaaagatttttggcaaagcgtaaaagactttttccaaaacatctttgacgcgatccggggattattccaataatgggaaagaaggcagtgcgcccctaatttccggcgctgctgccttctttttgttgaacattttgatctgtgctgccctgatcctgagcagtctttgtagtggtgcgattcttttccgtttcctgaccggaagcaggttctgtgccagtgttgtccaattttgtatcatctgtgttttctgattccttatttttattttgatccgtaaccttgccatccgttttcgcatcgttatgtttttctgtatcctgtttttctgttttcgctttatcctgcgtgccatccttcgctttatcagccgtatcagacttgtcgtttttttcttctttgtttttttcaggagtgccgccctgcagcagttgtgtcagctgatcagcctgctttcgcaatgtttcctcatctgaaccggaagtgtcaatatcggctgcgccggtttccatcgataggttaagacccggcagatcggcattgtcagcaagctgttgatgggcaacaaggcggacgtttttcatgccgatctgtctggctttttccggaacgtaaatgccgccaaagttcacctttgtggcatcgacccgcatatttttcaattgaatcgggccgggggcattcatatggatcgtcaccggtccctcaggcgtttgcagcacttttgtgattttcaggccgtaaatggtgacatccgcatactgcaggcggagcatgacctgattttgttttgtcgctgtatcgcctgctgtaatcccgggcggaagcatcgcgccttccacgcggtctgcttcaatgatgaagccgtctgttacgggggattcagccactgaaatgtttgtaaaaaagcaaaaattaaatgcaataaatgcggctgtcaataggaaagattttgttttcttcacttgcctcaccatttctgtgtatagtctttatctttcttctgcactccctgcggcaatttcttccatcgggcccacaccagccggcacttcctcctgcctgattacccgccatgaaacagataaagacccgccgattataccgagcagggttccaatgaaaaatccgcccatcgcccccatgatggaaagaacagacagaaaaatggccaaaatgccgaacaccatattaaatttcggaaaaaaataacccattccgccgatcagaaaaatcaagccaccgaaaatgaggccgatcgacaccatgcttccgggcgcagctgcaatttcaagaagttgaaccggcacatataaaatgatcatcccggagagcaacgtaaacgttgccccccagaatggccggcttcttctccagtttctaaatttcatgcggaacatatggaacttgcccattatgatcactccttgaagaaaagcctattttttgacaaactgcacttttaggttcggaagatttgcgactttttggaataggtaatgtgtatccaggctgccgtttttgatcgttaaagtatctgccccttgtgtaaaagccttggaagcagcttgagggtcatcggcagtgacataattttctgaaatattcatattggtgaagactgcatccccctggacaagcgcagctttttgaatcagcccattaaggtgtacaggtgtgtttccgtcgcccgccgtaattttcacctggtaatcgccaagaaccggaatcttaacatcttttgaaataaccaagtcctggatcgtcactttatcaatttcattgacaaagaccggtttgacatggtcctcccctttggatggatccccgtataaactcccgtataatttaaacccggtaccttgcatttgtttgaatgaaacattgaatttgccgatgccgccgacagttgctgcaacggcaaccccgttaatgccgagtacagctaaaagtccccccaaaaaaataaggcctgaaagcagagcggtaaaaaaccatttttttgaagttctcccttgtccttgtaagactaatgccccttcgttcatgtaacaatcctcccctttaaaacttgatcatttaaaaaagatggtacgctaaaatatttaggtgaaaaatcccctcctttccaaatgatatcgcttacatttttctttattttattcattttggacaaaaaaatatattcctattattgtagggaattcaatggcttatggcctacaaatatcgtgtcggaaagccggtatgtttttttgcgcgccaaccaggcatgattatgataatattataggaaaaaagaccggtaaggggttagacaaaggagggagaaaggtgtcgctgtcgttaaatgcgcatatggacatggtcatgaaacatggagtggaccttttgcgctcgcaccagcagcaaattattgcggaatgtacgggaattttgcagtatttgagagaaacacataaaggcagtgcggatgcttttgaattcgctttcaattgttttgtcgcctttttccgttccggccagcaatcggttgagacgctgattgacgatatccggtcgcaatgggtgaaggaattccaccgcccgccggaaccgcatgttctcatctttattttaacactgattgaaaactctgttcataaagccataaaggaaagcacgacccggtcttttcatttacatccttccgtccagtacctgttttcgaaaatctgcgaagaaatgctgctcatttccaaacaggaaacttttcaaatggattcattttgtgagcagctaaccaaatccgagcagctccggatcgagtggattgcaagggtcagccatgtggatggggggtaccggctgaagaaagtgatcgggatggaggagaacgcgattgacagcgggctgtttgaacggacggatccttcatggttttggctgtcggaagcgctgctgaagcggacgccgcgccggaaaccggatgaaaggcgggatgtgtttccggttccgtggaaaaacgagacgttgattttttgtatgagcgaccaggatgtttcggccacaatcccgtttttaacctatgcgatgcatttgttgcagatggaggaggaacgaaacggaaaagtatatgcgggcgaccagtggaaagatgcagtcattttatttaacgaatggattatgcgctcccaggatttaaatgaagcgatccaaaacatcgcttttggttacgcacaatatttgccgtttgagcgctgtgccctgttccgttattcgcagagcgatgccgcgggattcggcctgttcggctaccattttaacaatacggcaatccggaatataaaggagacgatcgaccgttttccttccatttccaaaatattgctggggaaagggcagcaggtaaatatggtacagcatttccagccgctgtatatcccaaaagcgtcagaagagtttccgatgcagtatgtgaaggagtttgagctggaatcggtcgtggttgccccgatttatgtgccgtcagaaggggtgttaattggcggtgccattttggaccaggggccggggaagttttttgaagtggacagtagcacatttacggcgctgttgaaattcggtcagagcgcaggtgaactgctggccaagtttttaaaagcgaaccagtgggacgaaaagcagccggaactcgtccagctgtccgcccgggaaatccatattttgcagctcttggcggacggggcctcgacgacggaagcagcggaaatgctgcatttgagcgagtatacggtccgggattatgtctcaagcctgatgaagcggcttcacgctagaaaccggacggaagccgctgtaaaagcaatgcggcttgggctgattcattgaactcgccattttcctccgttatgcactttttttaaaaggcgaagtcatgagggcttgctgaacgaatccgattttgagtttgtacccaatttgtcagcaagccctgtctcaaagtatagaagaatccatttgcgaaaatgtgtaattttgtcttcttaatacgttgagtcggttttcgagtgctagcttttccctggagttgttgtaaaaatttttgccaaagcggtcagcatccatgccaaatttggggattttgcttatacagcaaatcctacgtaggtaaaaaattgtgtgtaaaatgatcgaagtccgggtaaaatacttttacatcctagagtctgctgcaaagttcaaagcccccgaatttacgggggctgtaaatttgacaaaataaaagtctcccaaaaaaatgggagatctagacaaaataaatcaattttcttataatttgttatgcaggcgtaaaaaggttttcgattaagtgtttaagtttaacaacaaaaaatacccccctatttttgttaaatcttttttagaagaacgcctgcaagagcaggtttcggcctgctcttttttctacacaatacagctggctctcttcacacaatttctcttcgaaatgtttatcacggcgctgaatctggatcatgcttagctaagttcgactagaattttagtgaaaatgggctgattctctgacaaataagaaggaaacggaaataatgggattttttaaagattttttcgccgaaagaattctcccgcacccgcaaatgttaaggcactcacttttgcagaaacaaaataattttgcacggattttgcacagaagaaatgcaaaacgcccgcaaacccttgctattaaaggtctgcgggcgttgctgttaagcggccccgagaggactcgaacctctgacgcacggtttaggaaaccgacgctctatccactgagctacggagccgtaaattgctaatatccgttcgatgtcaccttaaatattatagtgaatctgtcgttttgtgtcaatacccctgtagaccgctctctagatgtttatctcaaagtgtacatttagatgatagagtgccttcccatttttttcactcgcctgatccttcgagtaaaatattttacacatacgcttttccgaaaaaacatggttcttcccgcttcaactgccaaaacacttaaagaaacaattctatttcccaatatccaaattcttccttaaaacgcttacggaccaaaacaggcggacaacctgtcacaaatggcacatgctttacatacgataggatagagatttggttctctgcgtgagataaaggtttttctaccgaagtattgacctgtatttgcaatctgccccctgtcgcctcaacttgccggatgcccggtaaaattttgccggccgcttgccattccggctgccggcaaaaaggatggtttccatttgtgcaaaaaaacatgacaggaaagtaaccatttaactttaaaaaagatatgtggaaattgagcatgattgaaaaggggtgaagtatttgtttaaactgtttcttgatccgggacatggtggaaaagacccgggcgctgagggaaacgggctggaagaaaaagacatcactttggagattgccaaacagattcaggacattttaacaaaccattaccaaaatgcttcagtaaaaatgtcgcggacgacggacaaatttgtttctttggaagagcggacggatgccgccaacagctggggcgccactttttttctttccattcatatcaattcaggaaatggaacgggttttgaaagctatatttatccaaaatcaggctctgctacggcaacctaccagaaaaccatccaccaggaagtggtgaagctgaatgatttaaaagacaggggcagaaaaacggccgattttcatgtgctcagggaatcgatcatgccagcacttcttaccgaaaacggctttattgacacagcaagtgatgcgaaaaaaatgaagaaaagcagctggattgaagacgtggcacaggggcatgtcaacgggctggcaaaagctttcgagctcaaaaagaaaagcggtgcaacgtatcataaagtcgttaagggggataccgtttacgctttaagcaaagaatacggttcgaccatcaaagaaataaagaaatggaataatctagatgatgattataccatccgtgtgggggaaagattacgggtaaagtagccgtacaagcggcctttacccgttttttgtctgaaacaccttcctcctgtttccctaatctccccgtctttcagcagcttatataccctattatataaaatgaacgaaacgtggattacaccgtttccgctgcaaaccgtcatcatcagcaaaccaaactgatccttggtcttcatgtaaaaacttacgctcattttattagcctaacgccattttaaaattcccttaaatttctgctcacaaaaaaaccggcacacaggccggcttaaaaaggggataaaacagtgggtatttgtccagcatgcttactgctctgctgtcctcgctacatgattaattgtaaaccggttaccctaaaaaacaatgaaagcaacatcatcatttcatgaagtttcgattaaaaaatgaagaaaaccccgtcaaggtctccgccatggatttggcgcccgggattaattttcgtagccgtttacgatcagatcaagtttcccggtttccgggtcaatgacaagcccatggatcggcacttttttatccatcagcgggtggtttttaatgatgccgacactcttttttacgctgctttcgaccttgtcgaaaccgctcagccattcgtcaaggtcgattcccgcatgaacgagtgtttcaatcgcattttcgtcaaccccgcgttttttcatattctcaagcacggtttcgccttttaacccggtcatgccgcagtcataatggccgatcacaaacacttcatccgccttcagctgatagatggcaacaagcaggctccgcatcgtgctgtcgaacgggctcgttaaaatggcgcctgcattttttacgatttttgcgtccccgtttttaatattcattgctttatgtaacaattcaatgatccttgtgtccatgcatgtgaaaatcaccatccgcttgtcggggaatttggaagtcaggtaaggctcgtaagcttttttctccacaaattcctggttaaatgcaagtacttcatctaacaatgtcatcacatctcactcctttaagcatattttaaaatacaatggccggaaataaaagtatacacgttaaaaatgggagtaaatccttcaccttatggtttgcgaaaaaaccaggggcgtgttacatttaattcagagttattttatgggaaatgggggatttgattgggaagggagtttgacgcgctgtttgatgaatggtcccgctcctatgatcaaaccgttaccggtaatgatgccgaatacgaagaagtattctatcaatacgataaaattttggatgccgtcagagaccgggcaaccggttttgttgttgaattcggcccgggaacaggcaatttgacgggcaagcttttggagaaagggctaaagataatcgggatagaaccttctgctaatatgagaaaaatcgctcaaaaaaagcatccggatgttaaaataatagacggggattttttgaattttcatgtgcaggaaaaggcggatacatttgccagcacgtatgcgttccaccatttaacagacgaagaaaaaagggctgccatatcccttttccacacccggttaaaggcgggcggcaaaatcgtgttcgccgatacggtttttgagacggaagaagcaaaacaggagatgatcaaggaagccaaagcaaggggattctgccggcttgcggaagatcttgaaacggaatattacaccaccattcccgctttatcttccatctttgaggaaaatggttttgatgtctctttccggaagatgaaccggtttgtgtggctaatggatgcaaaaatgaaaggagcatgatcatcatgacagagatgaaaaaaatgaacgtagaaagctttaatttggaccatacaaaagtcaaagcgccatatgttcgccttgcaggagtaaaagaagggattcacggcgatgtgatccgcaaatacgatatccgtttctgccagccgaacaaggaacatatggatatgccggggctccactcgctcgagcatatgatggcggaattcgcccgcaattacacggataaaattgtcgacatcagcccaatgggttgccagaccggtttttatttttccgttatcaatttggatgatgatggcgaggtgcttgacatcattgaaaaaacgttaaacgatgtattgcatgccacagaagtaccggcctgcaatgaaacacagtgcggctgggcggcaagccattctttggaaggcgcaaaggaaattgcccggaaaatgctggcaaaacgcgatgagtggacgcaagtatttgcctgataacaggagacgagtgaaatgaagtatgcgaaaagcgtacacgaactgattggcaacacgccattggttgaattaaccgcatttgatttgccaaaaggcgtccggctgtttgcaaagctggaatactttaacccaggcggcagcataaaagaccgactcggcgcttatctagtagagcgcgcgtttcgggaaggtaagctgaagcgcggtgggacgatcatagaaccgacggccggcaacacgggcatcgggcttgcgcttgctgcgattcgttacggcgtgcatgctgtttttgttgtgccggaaaaattcagcgtggagaaacagacgctgatgcgggcgctcggggctgaagtcgtgaacacgccgaccgaacttggtatggaaggcgcaattgcgaaagcaaaaaaactagtcgctgaaacaccaaatgcgtatttcccgggacagtttgaaaatccgtccaacccggaaacgtattataagacgcttgggcctgaaatttgggaagcacttgatggccatatcgatgtttttgtcgcaggtgccggttccgggggcacgtttatggggactgcccgctatttaaaagagaaaaatccgggcttgaaggcagccatcgtggaaccagaaggctcgattttaaacgggggcgagccgcgcagccaccgtacggaagggatcggcatggaatttttaccgccatttatggaccgtacattttttgatgccatccatacgattcccgacgatacagcttttaaacggcttgcggaagcagcccggcttgaaggccttttgatcggcagttcctcaggtgctgctttggaggcgagcctgcgcgaagcaaagcaggcaaaaccgggcacgcatattgtcaccatttttccggacagcagcgaacggtatctcagccgcagcatttattcttgatgagaaggagtttgtcatgcgtaaaaaaacaaaattcattcatgccggcattagccgtgatccatatacaggcgcagtttcggtgcccgtccatcatgcgagcacattcaagcaggatggcgtcggccattttaaatacgaatacgcacgcaccggcaatccgacgcgtgaagctttggaaaaactgattgcggatattgaagaaggtacacacggttttgcattcgcatccggaatggccgcgattacagcggtgatccagctgttttcggccggcgaccatattttggcaaccgatgatgtatacggcggtacttttcgcgttttaacaaaagtgatgaaccgtttccatatcgacgtcacttttgtggacacgagcgatctggatgcggtccgtgcctcgatccgcccgaatacaaaagccatctacgtggaaacgccgacgaacccgctattaaaaataacagacttgcgggccattgccggtgtagcccgtgaaaacggcttaacatttatcgtggacaacacattcagcaccccgtattggcaaaatccactcactttaggtgcggatatcgtcgtgcacagcgcgacgaagtatctcggcgggcacagtgatgtggtcgcaggccttgttgtcgtacgaaacgaagcgcttgcagaagacttgcattttatccaaaactcaaccggcggcattctcgggccgcaggacagctggctgttgatccgcggtattaaaacactcggcatacgcatggaagaaattgaatccaacacaaagcaaattgttgattttctttctgcacatcctgccgttgaaaaggtatattacccggggcttatccatcatcccgggcataaagtgcacagttcccaggccggcggattcggcggcatggcctcttttacagtgtcatcccaggaaaaagcccttgaaatattgaaaaaaacgcgttactttacgttggcggaaagcctcggtgcggtggaaagcctgatctcgctcccgccgcttatgacgcatgcatccattccgcgtgaacgccgtctcgaacttggcatcgaagacgggcttatccgcatctcagtcggcattgaagacgtcgaagatttgttggaagatctggaaaatgcgctaaggtaaaaagttagcctgctctcatggggaagcaggctttttgtaacgttatcaaatggaaaatgttggtgctttgtttcctaccgcctggtcttgacgaaatgaatgaaaaaatttttaccacgtttttgcctgctgtaaaacataatcatcttgcgaattggtgcgcggcttggtataaaacttaatgccgccagcccgcaacgacaaatccacagtttaaaaaaatttcctctttcacgaaacttaaaccatttttaaacgtaatgatgagtaagcaatcatagccggcgtcatctgaaagaaaatcccaatcaaggaaggggtgtgatgtttatggaagtgttcggcgtgccgatagagacggcgtatttggctgtactgatcattgcgggatgcctgacggtgctttaccttttgttcaatgacttgcttggaggaatggcagacgccatcaattttatccatccagctttgattttggcattttttacttttttctcggcaggcgggtatattttggaaaaagtgacaccgctttcccacgtgctgattatggtcgtttccgccgtgatcgcggtgattcttgatattctgctcaatgtgtttgtacttgttccgctgtcttcggctgaagaatcgcttgtttacacggaagattcgctgaaagggagggttgggaaaacgattctttcgattccgaaagccggttttggtgaagtggtgattgacagcaaaacaggaaccatctccaagccggcagccagcatacaggacgaggaaattaaagaagggacgcaggtattggtgattgaagtgaaaaaaggcgtgttatatgttgtaccttatgagaattatcgtttgaaaattgaaaattttagtcaatgataaggagggatccgcatgtttgcgagcggaatttggattgtcatcggtgttgttgtatttttggtgcttgcccttatcggcgtctttatttcaaaataccgaactgcagggccggatgaagcgttaatcgtgacagggagttttcttggcggtaaaaatgtccatgtcgacgaagctggaaataaaattaaaatcattcgtggcggcggtacatttgtgttcccggtattccagcaggcaaaaccgctcagcttattatcgagcaagctggaagtgaccaccccggaagtctacaccgaacaaggtgtcccggtgatggcagatggaattgccattattaaaatcggcgggtcgatcggtgaaattgccacagctgccgaacaatttctcgggaaatcaaaagaagaccgcgaaaatgaagcgcgggaagttttggaaggccatttgcgctcaattctcggttcgatgacggttgaagaaatttataaaaaccgtgataagttttcacaggaagtccagcgtgttgcctcacaggatttggcaaaaatggggcttatcatcgtgtcgttcacgattaaagaagtgaaggataaaaacggctaccttgatgcgcttggcaaaccgcggattgcccaggtcaagcgcgatgcggatattgccacggcagaagccgaaaaagaaacgagaatccggaaagcggaagcattaaaagaagcaaaacgcgcagaactggagcgggcaactgaaattgcggaagcggagaagttcaaccagttgaaaattgccgagttccgccgcgaacaggacatcgcaagggcaaaagccgaccaggcgtacgatttggaaacggcccggtcgaaacaggatgtcaccgcacaggaaatggaaatcaaaatcatcgagcggcaaaaacaaatcgagctcgaagaaaaagaaattttgcggcgcgaacggcaatacgactccgaagtcaagaaaaaagcggatgcagatcgttattcggttgaacaggctgcagttgcagaaaaaacgaaacaaatggcggaagccgacgcccacaaataccgggtggaagcgatggcgaaggcagaaggggaacgcgtccgcattgatgggacggctaaagccgatgcccagcgcgcccaaggggagtcggaagccgaagtcatccgcctcaaagggctggccgaagcggaaacaaaacgaaaaattgcggaagcatacgaacaattcggccaggcggctgtgctcgatatgattttgaaagtgttgcctgagtatgcgaaacaagtagcaggcccgctttccaatattgaccaaatcaccgttgttgatacaggaagcggcgcaaacggcggtgcgaataaaatcaccggctatgcaaccgatttgatgtcgaccttacaggaaacgttgaaagcttcaagcggcattgatgtccgggaaatgctggaaggcctttccgggattaagccgcaacaaacagcggaaccagaaccggaagccttggaacaaagcacaaaagggtgaaaaaaacggcgtgtttttgccaaatcaaaaggcaaaagcacgccgtttcttttaaaaattaaatgtgtccggttattttcctgcccctgcagtcattttatggatgaactggagggagcggcccgcgccgactaccacagattgcagcgggtttggcgcgagatggacaggcacggaaatttcattgctcagccactcctgcatgccttgaaggagggcgcctccccctgttaaaacaatcccgcggtccacaatatcgccgcttaactctgccgggcagtcttccagcgtggcacggaccgtttccaaaatttggagcagggaatcacggagcgaagcctgaatttccaatgaacttaatgtaatggttcgcggcagtcctgccacgagatcgcgcccgcgaatatccatcgtttgttccggatggtcgacaagggcatgcccgatctccattttaattttttccgctgtccgttcgccgatcagcagattatacgtttttctgacatgctgcataatatcatcgtccattttatcgccgccgatgcggatcgtgttatacgtcacgacgccgccgaaggaaataatggcgacttccgtagtgccgccgccgatatcgacaatcacattggcgatcggctcgtctacgggaagatcggcaccaatggcggcagcaaccggttcttcaatcaaatggacggtttttgctccgctgtttttgacgacatcttcaatggcccgccgttcaaccgatgttgcgcctgacgggacacatactacgacgttcggtttgcggatcgagatgccgctttgctgattgatttttttcataatttgctttagcatttctgttgtcatatcgaaatcagcgatcaccccgccttttaaagggcggatgacagtaattttttcaggtgtttttccgatcatcgctttggcttcctgcccgaaagcgagcacctgccttgtcgaatgatcaatcgccacaacggacggctcgtctaaaataacgccttcttttttcgaatatactaaaacatttgcagttcctagatcgatcccaatttcattccctgaaaacatgcatgtcacctaacctttatcatcttttcgcacggattaactgtagtctctcccatttagtatagctttttttcttcgttctgaaaggttacattttcttccattctcttatgttacaaaaatatgatcgcggcaagtccataaaatatgcgaaaaacagctatagccggcaccccaaatttaatctttttgtaattttgttcacaatggaggataggaaaaaattccttttgtttcaaaaggaattttttctacagaagcattacagcggcattttggacaaatagcgcgccaattcttcactttgttgtttccgcagcacccgctgttcggcacgctggatggctgtttggtttaaccatcgttcctcgtcggtttccgggataatttccggcaccggtgtaggttttccatcctcatccagtgcgacaaaggtcaaaaaagaaatggcggcaatttttgtctcttctgttttcaaatcttccgcggtgacctttacaaatatttccattgatgtccgccctgtccggctgaccatggcttctaccgtaacgacgtttccgacgcggatcggtgcgataaaatcaacagagtcagtcgaagccgtgacaacggtgcatcttgccaatttggccgcggcgatcgatgcagtatcatcaatatacgccatcagttttcctccgaacagtgtgccaagatggtttgtgtccgggggaaaaacataactggttcttactgtacgggtttcccgcatgtatcttttcggtctgtcttccaaaagtctcactccattatgtcggcgctgtcaaacgcgatctaaatttccttttaccatatagaaaattatagcaaaatcagttggcatatacgaacaaaaatgtatagaaaaaaggctttcatccggaattttttcaaaagaaaaatcaggtccggcacttcaacctgatttttgcttgcttatttcttttttttctcgtcttccacataaggatctttttcgttgcggggcagatccccgaacggcgtcatcgtatgggtttcatccaattcttcttcatattctttgtattcctcatttggatagatttccacgttttttccgttgatgtcattgccggaaaagttttcaaaatcttccacatagccgtcatggtcatctgattccgtatacatatcattgtaactgtctggtggggtttcaaaatcggaaggggactcggatgtgccccattttgcgacagcctgccaggagtcttccgcgtcaaaagcgaccgattcatcttttccattatcaaaaacgaattttccccacggcggattcagcacgttttcttcaaccgggcggtgctttggaatggtccgatccggggtgtgctctttgcagtacagcgtggaaggaagcgtttcaagccgctcaagcgggatctctttgccgcattctttgcatcttccgtaagtgccgtcctcaatggctttgagggccgctttgattttttccacttcatattcagcgtggtcatttaaagcaatatctttttcccgctcgaacagttcggtaccggtatcggcgggatgattatcgtaactggacagttccccaacggaatcgtaagggtgtgccgtttccgtttggaaatggtcatttttcccgaattccgcttcaaattctttcagctgcgcggttaaaatggaacggaaatgcgccagttgttctttagtcagcatactcaccacttctttctttaaaaaagatgggttcaatcgtgttagagtctatttaccaccgggaaaaagtccgcaaacttttctaaaactagtatggttcaaaatgccgctgttcatgaaaaaaagtctgcccgtttaaacagacagactttttagcatattgtgcatggatcgtgctcgttttttcaagcagacaggcgtttcttttcatactggcgaaacatcagcacatacatccccgcgctcatgaccgcaagcacggccaggatggaaaacgttcctttatagccgatccagccggcaagcgggatggaaacaggggcaattgtgcgcccgattgtattgcgcaagctggcagcggcaaaatattgcgcgcgcatctcaggcggggaaagcttcgacacaaagtcttgctggatcccggttacaatcagttcgccaagcgagaacaacagcatcgagaaaataaagccaatgcttgaaatccagacgccaaacaaataaatcgaaatggcatacaggagggaggaaaggacaaacacattccgttcccggtaccttgttacccatttcgtcgccgctactgaaaaaagcgcgacaattagcccgttttcggataaaataaaaccgtacagctgctcgccggtaaagtgaagcagatggagcaaatctgtttcaggaatggcctgcttcgtgaataccggcaaaattaaatcaagctgcatatacgtttgggaaatcaggattccggcaaaaataaacaacataaatattttatctttgacaatcacatggtagctctttgcctgttcaatcagcgtactgtaccattttttacggacgcgatgttgcccgcctgcccaaaccggtgctgtttcccgcgtatatttgacgagcaaaacgccaagcagaaaacaggcaatagcagcaaaaacaagcagttcaaaacgataatccgcaaaaaatatcccgccaattaccgggccgataacgacggagatattcatggaggtgtaaaaaacggcaaacacatggctgcggtttttctcatcgacaacatcggcaatcattgcctggcttgccggataataaaaagaaccgaaaacgccggcagccgtaaagcaaataaaagctgtcacggcggaatgaaaccatggcgagttggcaaatccgaaaatgaaaaaagacacgccctgcccgattgaagccaccaccatcattttctttctgccgaagcggtcggcgtagtatcctccgagtaaattggcaatgacggaaaaaacttgtgagacaatcaacaggacacccgcaagcccggccccgaacgcctcggtgaaataaatggtcagaaaggggaaaaacatccaaaaggtgatattcatcaatgattccccaagcagacggacttttaaattttgatcccaatcacgtattctcataaatatttcctcatctgtccagaattggtatcaatcctatgataccagaaaaagcggggaaaacaatgaagaaagttaaggactgggcaaggattgaaagggggcttgccaaatgtaccggataaaacgaatttatgaagaacctggcgaggatggcagacgcgtgctggtcgaccggctctggccgcgcggcatatcaaaagaaaaagcggcactcgatgcctggatgaagacagttgcaccaacgagttccctcaggaaaaaattcaatcataatcctgcgctttttgctgaatttgctgcgctttataaggaagagctggaccggctggaagacagaacggaactggaccggctgatcgaatggggaaaggctggaacggtgacattgctctacgcggcaaaagacgaaaagcacaaccaggcggtggtgttaaaagaatacctcgaaggacgggcataatcgaaaggcgccgcatacgttgcggcgcctgttattatgggttgtgcatacggtttttaaacgcttcgtgcgggatcatttgctcttcgtcatagttgctgtctttgtgctgcttttcatcggtcatctggtctttcggaaaacgacccggatgaccttttcttttatggtcgaacatttctccgcgtcccatcatcgttcccccttcctgcctatagcgtcccttaaacaaaaggaaatatgtacccgaatacggtataatagtaaaaaagcgaaaggggtgccgacctgtggatttcatgagaatgacggaagataaaatccggaaagcgtatgaagaagggcaatttgaaaatctgccggggtacggaaagccacttccgaaagacccgctttccggcgtgccggaagatttgcggatggcttaccggattttacagaatgccggtttttccccggaagaagccaatttaaagaaagaactgctttccattgaagatttaatcaaacaatctgaaaatgaaatggaaaaagaaggattacaaaagaaactgagcgagaaactgctggcgtataaccaaatgctctccaaaaaacggatcaaaacaaacagcgctatttttaaaaattatcaggataaaattgaaaaaaagctgtttgattaagggacgccgcgaacacgaccggaagtgaagcggttccgtttcaggcagcccgttagaaaatgggcggcgtcccggatatggtacagggtgctgttgaattgtaatcgcttactaaagactagggaactgaaatcagctgtcccatttacaagggcgtttaaaaaccgcatcatttttcccgctttttttactataaattgccgccatccatccgatataatgaaagaagacattatgatattcaggtgaaaaaaatggataaatcatcaattatcggcgtaattctgggtgttgtggcaattggtaccggcatggtgttaaaaggggtaagcccggctgtcctcgtcaacccggctgcccttttgattatactggcgggaacggctgcgaccgtcattatcggtttcccaatgagtgaattgaaaaaagttccgaaactgttgaagattatttttacggaacaaaaactgatgagcacggaagaaatgatccgctttttttccgactgggcccagactgctcggagagaagggctgctggcgcttgaagcaaggctggatgaagtcgatgacgcttttttgaaaaacggcctgagccttgcgattgacgggcagagcgccgaatatatccgcgatgtgctgagcgaagaaattgaagcaatggaagaaaggcatcagatgggggctgccattttttcacaggcaggcacgtatgccccgacactcggggtgctcggtgctgtattggggctgatcgctgccctcggaaatatgtcggacacagaagtgctcgggcatgccatttcagccgcattcgtggccacactgctcggaatttttaccggctacgtattgtggcatccgtttgccaataaattaaaacggaagtccaaaaacgaagcaaaaaacaaggaaatgatgctggaagggattctctccattctggcaggagaatccccgcgcgtgatcgaacagaaactggcgtcttatttgccaaatgaagaacgcatacaactgatggaagagattacagaaggcagcgtggcaacaaatgagtaaaaagaggaagaaaaaacaagaagaagaggaaaacagcgaggcatggctcctgccttattccgaccttttgacattgcttcttgcactgtttatcgttctgtttgcaatgagttccatcgatgcccagaagtttcaaagattttctaaagtcttaaacggggtgtttgttggcgggacgagttttttcgattatacgaagcagacatccggagatgataacggcacatccgacacagaaaaatttatcgagcaaaagaaaaatgatgcacaaaagaatggggacagcacaacaaatggttcaaaaagcaacagcacaacaaatgcatcaaatgggcaaggggacgcccaattaaaagaaacccagcaaaaaatcaacacgtacatagcgcacaataaattggaaggaaagtttgaaacgtctttgacaggcgaagggcttttgattacgatccgagacaatgtcctgtttgattcgggaaaagcggaggtccggaaagaagatatcaaaacagccaaagccctttccaatttgctcgtaatggatccgccaagaagcattatcgtgagcggccatacggataatgtgccgatccacaactccgtctttcaatcaaactgggacttaagcgtgatgcgcgcaaccaattttttaaagatcattttagaaaacaaaaatttaaatccgaaatatttttcggcaaaaggatatggggaataccatccgattgcatcgaatgatacgccggatggccgggcaaaaaaccggcgggtggaagtactcattctcccgaaaaatgaggaaggaagcgactggtaaaaccacgcaaaaagagcgcccggatccgtatttccaatcgccccatcgttccgtgaagcaaactgtttgtttaaaaccgcacaaacgaggtaaaatataaacgtcccaaagattagaaaaggagatggttcgattggctaaaaagatcgctgtacttgtcaccaatgaagtggaagattcagagtacaccgaaccggtgaaagcatataaggaagccggccatgaaattgtcaatattgaaatggaagccggaaaaacggtaaaagggaaacacggcaccgaaatccatattgacaaaggcatcgatgatgtcagcgtgggtgattttgatgcccttctgattccgggtggcttttctccggaccaactccgcgccgacgatcgctttgtccaatttgtaaaacagtttatggattcgaaaaaaccggtgtttgcaatctgccacggcccgcagcttttgattacagcaaaagcattagaaggccggtctgctacaggttacaaatcgatccgtgttgacatggaatatgccggtgcgaacttccgcgacgaagaagttgtcgtatgccaaaaccaacttgtcacaagccgtacgccggatgacatccctgcatttaacagggaatcgctgaaactcctgaacggatgagcttgtatgtaaaaactgctgcctctttccgggcagcagtttttttactttgcgcacaatgcaaattagggatatgataaatggagcggggaaacagaaaatgaacttttacatagaataatgttgccataatgaaaggaagtagaagatgattacactgaaatcgcaaagagaaattgacatgatgaaaaaagcaggcaaactgcttgctgatacgcataaaaaaattgcaaaaatgatcaagccggggatcacaacatgggaaattgaggaatttgttgaccgttatttaagggagcacggggcaacccctgaacaaaaggggtaccaaggctatcagtatgcgacatgtgcaagcatcaatgatgaaatttgccacgggtttccgcggaaaacgccgttaaaggaaggagatatcgtcacgattgatatggtcgtcaacctgaacggcgcgctggctgattccgcctggagttatccggtcggaaaagtaagtgagcagacgcaaaaactgcttgatgttacaaaagaagcgctttataaaggaattgaacaggccaaaccgggcaaccggatcggtgacatcggccacgccattcagacgtatgtggaagcacaggggttctcggttgtccgcaattttatcggccatggcatcggcccgacgatccacgaaaaaccggaagtgccgcactacgggctgccgcataaaggaccgcgcatcaaagaagggatggtcatcacgatcgagccgatggtgaatatcggcagctatgaaacgaagatggatgacaacggctggacagcccgaaccatggacggatccctttccgcccagtatgaacacaccattgcgattacaaaagacggcattgtgatcattaccgatcaggaagattaatgctgcactgaaacacggatccgggtttctattccggaaacttaaaaaagctgggaggcaataaaactcccagcttttttacattctgaaaccttcaaaggcttcccatgcttcgatcccaaaatcagggagacaataaaggctcccaattttttgcattctaaaaccagccggcatcaatcttttttcaggcttccgagctcttccacaatggcttgcatttcattcgggctgaatgtattttttttcattaccatttcgtataagtcaaacaaatcgtcataacggtcaatgctaaactgggacgactgcagtgccgccgtattgaccatttttaatttcgctgtgattgcctgtaccatataggccatattttgcgctgatttttccgaaagatccaacgttttcacccttttcgtgtttttcttgttttattataccgcatgactaccgatccggaaacgtttcatacgaaacggagagggaaatataatggtaaaccgaacggacagagggtgataaaattggataaaattgcactccaggcagaaaaaaagcgttcaaccattgcggctttgtttgagaactcaaaacggaacgatattaccgggatggctgcgcagttatcttacttttttcttttatctctatttccactattgatctttttgtttaccttgcttccttatttgccgattaaaacggatgatgtattaaatatggttcggcattttgcgccaagccagtcgttcaagctgatcgaaaccaccttgaaagaagtgctgatcaatcggcacggcggcctgctttctttcgggatgatcgcgactttgtggtccgcttcaaacggaatgaacgcggtcattaaagcattaaacagggcttataaagtagaggaatcacgcccgcctgtcatgcaacggctcatgtcggtgatgctgacacttgggatgatcatcgtgtttatagccgttattttaattcctgtgttcggccagcagctcatccattatgtgttttcttacttcgggctgccgaatgatttgaaaaatttgatcaatattttaagatgggcgcttacgccggtactgctgtttatcgtgttttccttgttatacttttttgcgccgaatgaaaaatttggctgcctgacggttgtccccggagccatttttgcaacagtcggctggattgtggcgtcactcgccttatcgttttatgtcagccattttggaaattataatgccacatacggcagcctcggcgggatgatcatcatgatgctttggttttatattagcggcatcatcctcatttttggcggtgaactgaatgccgttttaaatgataaacacaaaaattgctaatttggatcattgcttttatgcgcatattaaaaaagcggaaaattaccgtgacatcttaataaaaaatcgaagcgttctaagtgaagaaaggcggacaaatttcttcgttagaggaaggcagtcaaaatgccaagcgataaacgcagagatccccgggttaagatcgcggccggtttttcaggtagatcttatcgtagccgttctcagcaaaggaggttgctgagaacggcggacaaaaggcaaagccggaagcgggcagctgtcaggagtgccggggaacagcagcggccgtttttttgaaacggaaaatcaaaacggacaaaacaagcaatagcatacaaatcagcaggaaaaatacgggcccttttgtatatttaatgatcacgccccaaagataagggccggccatgctgccaaagctgtatagaatgccgcacatgatgttgccggcgggaagcagcggccgcggcagcagatcggacaggtaactgatcccgagggaaaacgtcgagccgacggccataccggcaacgaaaaagcaggcaaacagcgcgatggcgtttgatttgctaaaagcagcccccgcaaaacaggcgcagccgatcaaaaggactgcaatcaacacttttcgccttccgaaccggtcgcttaacatgccgagcggaagttgaaaaacaatgcttccgatcgagaaggcagggataatcatggaaacggcatcgacatttattccgtttctcaatgcataaaccgggaaactgctgtttaaagacgattccatgaatccgtaaccgagcggcgggagcaatgcaacccacgccaatttccacacctttccaaaacgctgaaatgtggccagaaaagaaacattttctaaatccgcttccgggtgctcattttttaaaagaaaaacggttagccagaaacaaaggctgatgatggagcaggtaataaaaggaaggcgttcatccacatttacaagccttgtcatatacggcccgacggcaaatccaaggctgaaaaaaagcccgtatagcgcgatgttccgcccgagccgccctttccgggagaaagacgtgatccatgtctgcgccgaaaaattcagcatatggtctccaatgccgatgaaaaggcgcaaaataaaccaaaaccataacgatttccagaacggaaataaaagcagtgaggcaaaaacggtcagcccgcctgttaaaataagcggtttatatccgaatttccgcagcggcgcttccatgagcggggacgcaaataaaacaccgatatacaggccggttgcatttagcccattcaatgatgcatcaattccgtctttttcaaaaataatggaaatcagcggcaaaagcatgccctgtgtaaatccggaaacagaagtcatcaacaccaaaatccaaaaacgcatattttcataacgattcattgctctcacccggcttgttctcgttgtgcattcgctctctatagcataatcagatcagaaaaatttggcaagccaaccgatcttttgtaaaattttatagaaagcagataggaggatggctatgaataaaatgtttgccattatggtgatcatcggggttcccgtctcggttgctggagcacttctgcactggccgaacgtgttgatgtttgccgtttactgcctgaccatcattgcactggccagctttatggggcgggcaaccgaaagtctcgccattatagcgggtccgcggatcggcggtttgttaaacgccacattcgggaatgcggtagaattgattatttcattgttttccctagcggccgggctccatcaagtcgtgcttgcttctttgacgggctctgtgctcggaaacttgctgcttgttgcaggcatgtcgtttttgttcggggggatcaaatacaaacgccaaaaattcaacgtatatgatgcacggcataactcaggccttttaattttcgcgatttttgtcgcttttgtgattcctgaaatcttttccatgaagatgtcagaagggaagacggtcagcctcagcattggcatttccattattttaatcctgctttacttgtttgccctgttttttaaactggtgacacaccgcgggatttaccaggacagggaagcccgggtcaaggagcaggaagaacacgaagagccggaatggtcaaaaggaaaatcaatcattgtgcttgcccttgcgacgcttgcagtggcttatatctcggaaaatctcgtacatacttttgagtccgttgcaaaaagtttcggatggagcgaaatgtttatcgggattatcatcgtcgccattgtcgggaatgctgcggaacatgcttctgctattttgatggcggtgaaaaataaaatggacattgcggttgaaattgcattcggctccacacttcaagtgtctatgtttgtcgtccctgtccttgtgcttgcatctttgttttttgaaaaagccatgccgcttgtcttttccataccggagctcgtctcgatgatcgctgcggtcatgcttacgatcattttggcaaatgacggcgaaacaaactggtttgaaggggctactatgctggcagcctacattatcatggggatcggcttttacttgctgtaatgccagaagttgtcatgcggctaaccagtttttttagtaacgccggaatgttaccggccgttaagcttgcacagagcggcgagtgcacgatgcatatagggatcaggttttatttgctggaagcggatattttaatccgggcaggaaaaaataacggtacgttcgtgaacctcttgtgaaaggagataacatcaatgaaatggatgcggacgatcctgattttcctgctcgccgtactttttgctgcgccggcgggagaagcaaagccgacagaaaaacaggtgcaaattccacagtcggtcctaaacattacaaaagaaaatacgtatccgaactcgtcacaggatctgccctacttgcagccaagcaagtttaccgaaacattgctgaaaacatccaatgtgagaattgaaaacccgaatctcgtgcggatgttgaatgaaacaagcgtgaaccgttcgtttttatcgctcggtctgcgcgcgaaaatttacctgggcgaatggccgctgaattatgaatccagcgaaacgtcgccaaactggcaataccaaaaaatcaatacgaactactttgataaccgcggcggcgatgccaattataaaatgcactacgtccaggaagcgcaaaagatcgtgcgcggcggcctgactgccaggattccgcaagcggacgatgtcaagaaaatgatgctgttaaaagcaatggaaaactcgaagttgccgctttcctttgacacgattatcggggccggcacaaaaaaaggccatgaatacaatgtcccgaaaaaacggctcggctatttgtatgcttatgccccggctgtgaatgaaaaaggaaaagtcacatacggcgaagtgtaccttgttcttaaagggacgaaacgggaaattttagttaaaaacgtcacttcccacggtattggcgcctggattcccattcaggactatgtttcgttcagtttttctgtgagcgaacagccaaaataaggaagtttattaagattggcccgggcaggttcaccggtttttggtttagctgctgaggaggcctgtctcatgccaattttctatgggcaaacgccaataagaaaaagctgtctgaacggcagcttttttctgtgccggaaatggggtatactataataagaaagtagtacgtgaggaggatttttttggggaaagcggtatatgataaggaccagcaactgacttatttaagggaacggctgaatatctttttggaggttctggattcgattgatccggaagcggcaagccttgaagatatagatcggcttattcaaatgatcgatgaaatcgaactgaaaatagaccaatttaaaaagcgcaaaccggccccttctttgtaaaggccggttttttatctggcagcggggaattcgggtgtggaccgggggaggaatgccgttttggaacgatgttgccctgtttttcagcgctaacagaaactgccagcatttccgcctgcagaaatgaaaaagataaggaaaacaacaaaggagtttggttatgagaaaagtttttgcgacactttttgcagtgttcctgtttttttcagtatgcccagagcgagatgcttttgccatttccaacgccccgatcaactggggatttaacaaaggcaaaaacgggcagcaggcggatgccggcgccgcttataacgcccttttgcaaaaatacggcggcatttataagggcaatccgaatgacaagtatgtgtatttgacgtttgacaatggatacgagaatgggtacaccccgaaaatactcgatgttttgaagaaagaaaaagtccccgccatctttttcgtcaccggccactatttaaaatcacatccggatctggtgaaacggatggtgaaagaaggccatatcataggcaaccactcgtggggccatccggacatgacacagatttccgatgcgcaagtacgtgaagaattggaaaaagtgaaagcggaaaccgcccgccttaccggccagaaagaaatgaaatatttgcgcccaccccgcggcatcctgagcgagcggacgctgaaactgggcaatgaagaaggctacacccatgtcctctggtcactggcttacctcgactgggatgtgaaccgccagcgcggcacacaatttgcctatgacagtatcatgtcgcaaatccaccccggagccattattttgctccataccgtgtcaaaagacaacgccaacgctttggaacgcgtgatcaaagacttgaaaaaacaaggctacaaattcaaaagcatggatgagttcatgaaaaccgagaaattgaaaaagtaaccaaagagggctgccttaaaagtgaagggcagctctgtttttcttgccggccagaagaaaaagtgcttgccgggtcgaatgagggtttgctgcataagcaaagttcctatggtgccgcgttcactgccgcatgggcgtctaattcgacaaatgcgcacgcggatcttttgcttttgtctaattgaaaaagctaattagacaaatgaccgtgccgatttcccacttttgtctaattggcagctctaactgtacaaatgaccacgccgctcatctgcaattgtctaattggaaacgctaattagacaaatgggcgtgccgcttgcctgcttttatctaattgaaaaagctaattagacaaatgaccgtgctgctcgcccacgtttgtctcattgttggaaggtctaactgtacaaatgcccgcgcatccctcctgcatttgtcccattgaaaacctaattagacagataaccggccgggtctttttatcctgtgatgttttcatgccgcgttgaatcggcaatgaaaagggcgagcgcttgtgctataatacttaaaaacgaattgagaggacgccatgtgggagaaaatcattaaaatcaatggcccgtacaattttgaccgtgcgctcgaaagattaagcctcgacccgttgcaggcggtggatccgcttagccggacagtgaaaatcccgatatacgacaaacagccggaggtagcagtcattaccgcaaccggcacaaccgaaaaaccagaattccggattcagggggaaaacgcggacacagcccagatggtggaaaaacggattttccatttatttcaatgggataccgatatcgccgggatctcacagcattttaccggcactgcccttgaaccgctttttaaagaacaccgcggcacgccgtttgtgctagacttttcgccatatgcctgcctggtcaaatgcatcatccaccagcagctcaatatgaaatttgctcacacgttgacagagcgtttcgtctataactttggtttccaaaaagacggtgtctggttttatccgtctccggaaaaaacggctgcattgcaagttacagatttacgcgccctgcagtttagcgagcggaaagcggagtatgtgatcgggctttccaaattggtggcatcaggcgaattagatctggtggcacttgaaaagaaaccggatgaagaaattttaaaaacgctcgtgaaaatccgcggcatcggcccgtggaccgtgcaaaattttctcatgttcggactcggccgcctgaatcactttccaaaagctgacatcggcattcaaaaggcattgaaaaaacttttccagcttgagaaaaaaccgacttataaagaaatggacgcttacgcaaaagactgggagccgtatttgagctatgcctccctgtacttatggcgcagcattgaatagaaggacggattttatgcaaaaacaagtcaccattaaaccaaaacagcaattccctttgacgatcaaacggctcggcatcaacggggaaggggtcggctattttaaacggaccgtcgttttcgtgccgggtgcgctgccgggcgaagaggtggtcgtggaagccaaacggatacacccgaaatatgtggaaggcattgtcaaaaaggtgcgcaaacgctcgccccaccgggtaaaagccccgtgccccgtctacgagcagtgcggcggttgccagctccagcaccttgcgtacaagcagcagctcatcgaaaaacgcgacattgtcatccaggcgctcgaacgccatacaaagttaaaagtggacgaactcgatatccgcccgacgatcggtatggttaacccatggctgtaccggaacaaaagccagttccagctcggtgaagaccatgggaaaatcatttccggcctttacagccttgattctcaccggctgatcaacgtcccggaatgcattgtccagcatccgctgacaaacaaagtgacacaagtggtgacacaaattttaaatgatttccatgtcccggtgtacaatgaaaaaaccgggaaaggcatcgtgcgaaccattgtcacaagggtcggcatcgagaccggccaggctcaggttgtgctgattacggccaagcgggaactgccgcgcaaagatgtcatcctttccgagattaaaaagcgcctgccggaagtcgtatcggttgcgcaaaatgtgaatgccaaaaaaacgtcggttattttcggcgacgaaacaattcatttatccggaaaagaaatcattgaagaacggctccaagaattcacatatgaactctccgcccgcgcctttttccagttgaacccgatccagacggtgaagctttacaatgaggtgaaaaaagccgctgcgttgaccggcaaggagaaaattgcggatgcctactgcggtgtcggcaccattggcttgtggctcgcggatggcgcatccgaaatccgcggtatggatgtgattccggaagcgattgaagatgctaagaaaaacgccgccgcccacaacatcccgaacgcccattactttgccggtaaagcagaagtcctcctgccaaaatggctgaacgaaggctggcgcccggacgttgtcatcgtcgacccgccgcgctcgggctgtgacgaatcccttttacggacgattttgaaggtaaagccaaagaaatttgtctacgtgtcatgcaacccttccactttggcgaaggacttacacatattgagcaaggcttataacgtagcctacatgcagcctgtagatatgtttccgcaaacggtgcacgtagagtgtgtggtctcgatgtcaagggtggagaaataggactgttcacttaaggccataacagatgtgatagatgttaaaagccaatacggattccttttctgggttaatttgataaaaatcatttatgaaaccggaggcgcatatgtatgaaatggtctgaagttcgtgaacattttccagaacgttgtgtcttagtggaagcattaaaatccgaaacaagaggaaaagaaagaatcatcgaggaaatgtcagtcattgatgactttgaaaacggcaatgcagcatggaaagtgtataaaaaactacatgcggaaaatcaaaaccgggagttatacatttttcatacgaataatgaagaaataaaggtaattgagcagccatatctaggcgtgcgaagaaaagtatgaaatttcatatggatgatcacttgcctctagtagctggtgagatggattacaatggaaataaaaagatatttaattattagcaaaaaggccctgttttcggaatcataaacattccgatttcaggggctttttttgtccaaacggtatcatccctgctttttcctgatgctccttttctttctctcatttttacttagtttttctgttgacaaacaaaataaaccagtatattatttactttgttaataggaatgaaaactaagtaaatatccttggaggttctaaaatgaaaaaagatgaaattctggacaaattattggaaattacgcatcagccatttctcatttttgtaaatgaagtagaagaaaaaacagataatgcttttgaaacgttgaagttgttggcagcggaagaaaacgtgacagcgggccgcatttctgaaatgcttgatattaagccgtcaagtgtgacgcaaattatcaagaaacttgaagaagccggcactgcccggcgtgaaaaatccgggcaagattcccgtgtaacgattgtaaaaattacggataaaggacgtgaaagcttaaaagagcgcagttccatttcaacgacgctaaaagatgtcctcttccaagggtttgcagaggatgagcttgcaatgttggatcaatatcttgaacgcatggtttccaatatttcaagtgaagcatttcaggataagctcctcgaagtcttcagcaatgataaacgctgggaactttttggaaaaatgagtgcccgtttcggtcgtgcacgagaacaaatgttggaacgcagcgggtttggtgggtttggcggccgcggatttatgggcggcgggttcgatggctggaagaaaggacgtaaaagataatggaaagaggattcaatggttcagtccgtaaagatcaaaccaaattttcaattggacaatttataaaactcatcaaaacgacgcaaccgaaatatctgttgctggcaatgggtgtcttattgctggttgtttcatccggtatacaaatttatgtgccaaaattagcgtcatcccttgtcaatcatttttcaaaaggaattgactatgggttattagggaaagtcgtagcactatttgttatctcagctattgtttctgcaattggcggaacggttctggggatttttggagaaaatgtaatccaaaacttacgaaaaagcttgtggcaaaagttaaccactttgaaagtgagctattttgacactgtcaaggctggtgaaatttcaagccgtctggtaaatgatacagcgcaagtcaaacaattgctggctgtaacattcccgcaaacattagcgagcatcattacagttattgggacagtatacatgatgttcaagatggactggcacatgactgcagccatgattgtagctgtaccggtcgtcgtgatcctcatgataccaatcatggcatttggaacgaaaataggacatatccgtcaagaggcaatggctcaatttaatgggattgcgagtgaaacattaagtgaaatccgattggtaaaaacttcaaatgcagaaaagcaagcacaagttcgtgccaataaagaaataaataaattgtttaaagttggaaaaaaagaagcggtctttgatgcaacgatgcaacccatcatgatgatggtatttatgagtatggtgtttgggcttcttgcttatgggatgcaccggattgcaattggtgaaatgcaaatcggcatattaatgagcttcttgatgtatttgtttaacttgattggggccatgccggtcattgcaaccctattttcagaaatggcaaaggctgccggttcaacgcgccgtgtacaagaattgcttgctgaaaagccggaagattttacgaaaggcattgaattggatttggctggtaaaaccttatcagtggaacatgtggattttgcctacgaagatgcgccggatgaacccattctgaaagatgtatcctttacggcaaatccaaatgaaatcattgcttttgcaggtccttccggcggtggcaaatcgacaatctttagtttgcttgaacgtttctatgcacctacaagcggatcaatcaaatttggagatgtgaagattgaagagatcaatttaacaaattaccgcagccaaatcggatacgtttcacaggattctgcgattatggccggtacaatccgtgacaatttgacttacggattagatggtacatttacggatgaacaactttggaacgttttagatttagcctttgcacgcaaatttgttgaagaaatgcctgacaagcttgaaacagaagtgggggaacgcggcgtgaaaatctccggcggccagcgtcagcgtattgccattgcccgggccttcttgcgcaaccccaagattttaatgctggatgaagccactgccagtcttgatagtgagtcagagatgaaagtccaagaagccttaacaaacttgatgaaaggtcgtacgactttagtcatcgcccaccgcttggcaaccattgtggacagcgataagatttactttattgaaaaaggtcaagtcacaggatcaggtacacatgatgaattggtacgtacgcatgaaacgtatgcgaaatatgtcgctgaacaatttaaggtagatacaccggccatgtaaagaagtattcacgatacagtgtaaaaaatgcttttttcattggggtgaaattttttgggggatgaaggatttaagaaaatatggttcaatggtactggatctttggtggagtctgaagaaaagtaagccagtccttggaagaaaatagccatcatgatcctccttttccccaaattcaaatttctcgtttcaagagcattcggtcaaaataagcctttttctttttttagaaatttatatttatttagcatacaaaactcgcatttgaataacggatgcattacaattgtaataagaataagaaaagtctcagaaatagaatgaatcattcaaattctgaagctgacaatcaattggaaagccttccaccagtatcttatcttgaacagagtgaatcacaataaaaaaggtaaactgggaattaggctggaaggggtagtatagggggccaatagtatgatggaaaaaatagtggatgtttctttgcttgtcgtggctgctgggttattagttgtgtgggcccgaaaaaaatactgggacaggcagaaaaggtaatgacgggatgctctgtaaagaagacaatagaagctgctacacactttctaaacgtagtggtactcgcgaaaatcccccacctatattaagggggagggttaatttgaaattcggataatcaagcaatcctatcaatcgtaacgggaaacgatatgaaggtcttcttactcattatggttgctgaacatcatttaagtgaaaatgttgcttgaatatccaacaaaacaccacgaaaggatatgggtttcctttcactttggataaaatgatagatatataagcaatttgaatattttaaaaaagtaagcatccaaatgagtggatgcttttcattttgccaataaagatttcgagtaaattgtataccagtaatctaatcagaagatccaaatgaagggtatctacccctttccggagtatgtcgaaacgcgataatttccgaaaagtgacaggcaacaccgtcaactttcggctatttttggatggcaaaaacattcaacagctgaatcataaagattgcctcacaatggtttttttacgatcgaacatcttcgttcacactacgatttacggttccttttatgccattctgagatttcctcaagtctttgtttgaatctggcctctgaaccttgatttgtcggatgataatacgcgtgccctgctaacgaatccggcatcgtctgcatcgttgttaatttttcttctgtatcatgcgcgtatttatatccttttccgtaatttaaatctttcatcaatttggtaggggcattgcgtaaatggaggggaacaggttcattcattgagttcagtgcatctttctttgcgctcatataagctaaatatgctgaattagattttggtgccagtgaaaggtaaatgacagcttgggttaagtgtacattacattcaggcataccaataaattgacatgcttgaaaaacagataccgcaatttctaaagcccgattgtcggctaaaccgatatcttcacttgcaaatctgaccaatcttcgcgcaataaacagcggatcttctccggcttccaacatccgtgataaccaatagaccgccgcattcacgtcgctatttcgcatcgacttatgcaaggcagaaataatattataatgctcctcaccatttttgtcgtacaataatgattttctgttgatcatttgggaaaggtcttctttcctgatgatgatggtatcctcctgcttatgcccatttaaaacagccatttccagcgtgttcaacgcagtacgggcgtccccatcggaaaattctgcaatggccaataaagtttgatcttcaatttcaatcttttgaaggccatacccatggggatttacaatggcctgttttaataattccacgatttcactactcgttaatttatgtaggacaaaaaccttagtcctcgataacaaggccgaattgacttcaaatgacggattttcagtggttgcgccgataaggataatgctaccattctccacatacggtaaaaaggcatcttgctgtgccttattgaatcggtggatctcatcgagaaacaaaattgtcttttcgcctaattgccggcgttcttcagcttctttcataacgtttcgaatatctttaatcccactggtaacagcactaaaattaataaattccgattgcgtttgatttgcaataattttcgccaatgttgtcttgcctacgccggggggaccccagaagatcatggaagaaagacggtcatgttcaatcatttctctaagcacttttcctttacctatcaggtgcttttgtccaacgaattcgtctaaatttttaggacgtactcgcgtggccaagggacggttttggtcattgtcgttctcaaataaagaagtttgcctcaaggttactccctccttgtaaaaacttttcccattacgcttctttttgtctgcttatgatcccgaccaaaatatctaactcaatggttattttagaataaccctgattcgcaaatgtatcgatttgttccctgttcgagttcaaggtcaaaagcgccaatttgattcatgctgttttgattaatgtcttgcttggtatagtgttggcagataatatcaccaaatgaaaaaggcgataccgtttcattattgttatagacctgaatgatgaaagtaaaacagaagcttaaaatgaaaaggtgggccccgaacagcaaaaaagccaaccagaaaggagggcacctttaaggtgaatgatatcacctctatctcaaaaatcaaatatgcgttgaaactacaaattttagcaggctgcctctttctgcagttttgggaaaggatgagaccttccgggactttggctgcttggaaaacgaccatgtcatatgaatctcatttgaagttatccacaattttaaaactatgaaagccggttcattcattttttcaaaaaaaatgcggcaattatgcttaatgcagtccgaaaaaatgattctattgacatacataataatatatttatataatgataaaggctgtggaaatacttggcaggatttccatgctttccggcaaaattccaataaaaattgaaaaaggcaaattcatcgaaaggtggagacgcaaagctaaagggactaaagtcagatgaccatgtcagccagttaccgattttacatcaaaaggactaatcggtaggggattagtccttttttcgttgtgcggatatcaaatgtgaagaacttcatttaacaagcaggaggaagcaaggatggcacagtttcaaacagataacaagcataaagcttttatcattacattaggcggatttgccgcaacagaaaaggcatctacgtttgtagacgatttaaaaaaagaagtttcaaaaattaatgtgaaaaattattcgttaattgtggattcatccgatttaaggacatttaagcccgaaattttgccggtgcttgaaaagagctatgcgttgtatatgagtttaggatttaaaaaaatcctgatgattacaccgaaaagggtgacgccgcgtttacagctgaagagaatcgcgaaaaaagtgaattttacgggtgaatttatcaatagtttacaagcgggattggaactttcacgttaaaaacagcttgaaggagttaagtaaaaatggattcgagtgtgacaataagagaagtctctgtctatcatcctgaaaaggtgcgccataacgattattacctggcccattttcgccagcaaggaaaagatattacaagacttttgcaagcgcttggcagagaaaacagatacatagcagattataaaactgaaaccactttaacaatggcggtggaagcatcaaagaaagtgctggaaaaaagcgggttggccggccgggatctcgatatgattgtatttgtatcagggacacctgaatacttttggccaccgaatgcggttgccattcatcaatctttgggcggaaaagaagaagctgttgtttatgatatgaatgcggcatgtgtcggaatggtggtagcagtggatcaagtaagccgcaatatgctcgcaaatccgcatatcaagcgtgcgcttgtcgtgggctccgagcaaatgcaccgctttgcaaacgagggggatgcggttacatatgccagtttcggagacggggccgctgcagtattgctggaaaaaagccatcatgttaaaacagggtttatcgactcagcctatcaagtgaacacagaatcaattgataaaattacttttccggcttgtggcgtatcccaactggttgagggaaaagccgaacaaaagaatagaaaaataaaatgggagaatgtaaacaatgacaatgcttttctgtctactgccgcgcttgttgaaaaattgctcagccggaatcatttaaccgcgaaggatattcaggctttttgcttttcccaattgtcacggaaaaatatatacaaaatccaggaaatcttcaaagaagacataagcaagttcccaattgtgggcacggaatatggctatacaggagccgctagcccgtttatggcttttgaacgagctgtaagcaccggccggataacgaggggcagctatgccatattttggtcggttggtgcgggaacttctgcttgtgccatgttgtataaacattaaatgtattgaatctgtttcaaatgaagggagccgtaccatgggaattaaaaaattgtccaaagccattacaatgggccaaatcaaaaccgttatcctgccttatattctcattggcattttgttggttggcagcatgttcatcatcccccaatacttaaccatttggtttgtgtctgttgccgcaatcctttatcttggtgtaggtttatggtcatctttccggttaaccgggaagttattaaaaatgaagcaatacgcttccagcctggagtcgggaaacctggctgaatcgctggaaattttaggtgcagatgaatttggcacgatctctaacttcttaaataatgcaacaagcaatatgcgaaatctggttggagatttaaaaaaaggaatagatcgtgtagatgccaattcagatgaattatcggcaaccatgacggaattgttttatgtgatggaagatgtgaaagaaacgataaatgagatggagcaaggcgcaatggaactaagtgcaagtacgcagcaaattggcgcatctgctgaacaaattgaaagttcaacgaagaaattagcagaaaaagcaaatgaaggaaaaaatatcgcgcaggaaattaagaaacgcgggacaaaagtaagagaggaagcaacagcatctgcaggctcttccaatcaaatttatacggaaaaagcggagaatattttgaaatccattcaacaagcggaaattgtggaggaaatcaaaatgctggctgatacgattggagacattgcgaatcagaccaatctccttgccttaaatgcatcgatcgaagcggcaagggcaggggaagcaggaaaaggtttttcagtagtcgctcaagaaatcagaaagctggctgaacaatccacccaatcggttgaaaatatccgggttgtcaccagccaggtccagcaagccttttcaaaccttattcatcattcaaaagaaattctggactatgtagacactaaagtgaatcccgattatgaaaaaatggtccgtataggggaacagtatgaacacgatgcggaatttttagaccgtatgtcgcttgaaatcgcccaggcttcgaatgacatggcaaacgcaattgaggaagtcaacaaggcgatacaacatgtatcttccacaagccagcaatccgctgcgggtacggaggaaatgtcatttaatatttccgaagtgtcactggcaatgaaagaaacggcagaaatggtagaccaccagcatcaattagcccataaaataaatgagtctctccagaagtttagtttataaaaatataaactgaacaaaatatctcggctctgttgcctgctataaaaaataaccctcatgcaaatggtgcacacgctggatgtaaaaacttcagttcatatatagcaaatttcagcttataagagaagtcatgctgcagcacgaggataaacaggaaaattccggtttgtccccgtgctgtttctcgttaaacgccgctctttatttttgctatgcgacaaattttactgccggaatccccggttcattgaatccccgcacattgccaagtggcaggacagccaaacatgattcatgaatccccgccattcggggaaactgtttaatacagttcgcatgaatgggggaaacgtgatgcctgaattgccggaaatggagacctataaaacatggctggcgtcattgattggcggccggaccattacaaatgccatgattcagcgggaaaaatcgataaatatacctgccggcaagtttatgaaggcagtgactaatcagaagatccaatcgatttcaaggcgcgcaaagtatttaattttccagctcgaaaacggttcgtgcctgcttctgcatctaatgctcggcgggtggatgttttttggcaaagaggaagacaaaccggaccggacaatacaaatccaactttcttttggagaccggcacttgtttttcattggtttgcgtttaggatacctgcacctattaacaccggaagcggttcaggcggcgtttgaaaaaatcggccccgaaccgcttgatccccattttacattagctgcttttcaacaacggatgcagcaaagaagaggcattcttaaaacagtattaactaatcaagaagtgctggccgggattggaaaccggtattccgatgaaatgctatggcacgcgcagttgcggccggatcaaaaagcaggtcatcttgacaatcagcaactcgcccgtttgtatgagtcgatccggtttatccttcataaagggattgagcagggaggttatatggaacatccgctgcacgtgggagatggcaaaacgggacgctatcaaatgtacgttcacggcagagaaaatgagccatgcccgcgatgcagctcccctattaggaaagaagaaatttcttcacataagacttatttttgtccacgttgtcagtattgaaaacggatctgcccctgccgcacttcattttcccagctgcctgtcagacttccccggcctgcaattttataaatttccgctttcctacttgtatgatgagtccgtctgttacatgaacagcatcgtggatatcctttactttttctccatttatccggatgccgccgttttgagtcatttttctggcttcactttttgatggctgcagcttcaattgtacgagtagatcaatgatgtttattgttttatctccgtcccatagcatgaccgggatatgggcaggcaatgctccttgttgaaaaacatttttgaagttttcttctgcctggattgccacagcttctccgtggtacatgcggacaatcgtcctggccagcagcattttggcatcgcggggatgcagtaggcccacttcaacgtcgtgtgcgatttttattttttttgccagtgctaaatctgtgacaaggttaagaaatagtatagtttgatcaaaagtaccgaaccatgttataagtgtaaaagaggctgaaatattttttgcttatttattttgtgttggcttggtatccagataggggaggttatgatttttatcatgaaagaaaatttttggcgtgatttaccacggccattttttatactggcaccaatggaagatgtgacagatgttgtctttcgccatgttgtaagtaaagcgggcaggccggatgtgttttttacagagtttacaaacacggaaagttattgccaccccgaggggaaccaaagtgtgcgcggccgcttggcgtttacggcggatgagcagccgattgtggcccatatatggggggacaagcccgaatatttccggcaaatgagtatgggtatggcaaaactcgggttcagcggtgttgatatcaatatgggctgccctgtgccgaatgtggcaacaaaagggaagggaagcggtctgatccgccgtccggatgttgctgctgaacttatccaagccgcaaaagcaggcggattacctgtgagtgtaaagacgaggcttggttatacgtatgtggaggaatggtgggactggcttacgcacatattgaaacaggacatcgtgaacctttccatccatttgcggacaagaaaggaaatgagcaaagtggacgcccattgggaactcattccggagatcaaaaaactgcgtgatgaggtggcaccggatacccttttgaccattaatggggatgtccctgaccgtcaaaccggcctgaagcttgcacgccagtacggtgttgatggggtgatgatcgggcgcggcatttttaaaaatccgtttgcttttgaaaaagagccgaaagagcacagcagcaaggaattgcttgatcttttaagactgcatctggatctctttgacaaatattcaacagaattggagccgcgcccgtttccaccgcttcgccgcttttttaagatctatgtcaaaggtttccggggagcgagcgagttacgaaaccaattgatgggcacagactcaacagatgaagtgcgcaccttgcttgatcactttgaaacaaaacagatggagggggaaacggtatagcattccccctgaatacccccgatacaaaaacagcccggatttttattatccctttcatcgcaatagatgcgcggctgtgccaaactgtcaaaaggctgctgcaaaaagacaggaaaacaccggagaccactacaccggctctttccatcggtcgtctgctaccgcggcactcacatcggcatatgatggttccatcgtttcatacggcttccgcaaaaaaaggatcccatccatcccgggtttgctgccgttttggcggcgcacagacccgaaaatcccgtgaaagttccaggttttgccgtaaaaattccgtccaatccgcccggctttttacggcaggggaaatcggcattttcaagtatggggcgcaagcagtaaggtgcccccattctccgctgtttttgcggtcataatgcctggcattgccatattaaggaggcgtgcaggtattttgaatagcaagagagaggccggttcaaaataaccgtaagaactgatttttaaaaaagaattcaggtgaaaaggttggcggaaaatacaaaaaaatggtatggatccagaaaaagacccggcagaagattgaaaaaagatgatattaccattgtggatacagatgtgacaaaaaaagcagtggtcgcaacggctcttggaaatgcgatggagtggtttgatttcgggatatattcctatttggccgtcatcatcggaaaggtgtttttttcagggataaccggctcattgcaactggtctattcgtttgctacttttgctgtagcgtttctcgtccgtccaattggcgggatgttttttggcatgctgggcgataagttcgggcggaaacggatattggccgttactttagtgttaatgtcactggcgactttaagcatgggtttgatcccgggttatgcaaagattggaaatctagccccgtttctgctgcttgtcgctagactggtccagggcttttccactggcggtgaatattcaggtgccatgacgtacatcgcggaatcttccccggataaaaaaagaggctttttatcgagcgggctcgaagtgggcacgttgtcgggatatattttaggttccggcgttgtcacgatcctcagtttttggcttggcgaagataaaatgctggactgggggtggcgccttcctttctttatcgctgcgccaatgggcttgattggcctttacttgaggaatcatttggaggagaccccggtttttgaagcgatgaaggaagggaagcacaaagaaaatgagaaagggctattcaggaaagttttccttttccattggccgcaattgctgaaagggatcgttctcgttttattttttaatgttgtcgattatatgttgttgtcgtatatgccgtcttacttaagtgtcgttctcggttacgggcagtcaaagggccttttattcattctcattgtgatgtttatcatgattccgattgtgctcatcatgggctattacagcgaccggatcggaagcaaacgcatcattatgggaggcctggtcgggctgatttttctgtccatcccggcatttaagctgattggaagtggaacgaatttaacggtctttttcggcttgatgatcttggccgtcttactggcgacattcgagtcaacgatgccatcgatgctgccttctttattcttcacggaagtaagatatgttgcgctggcgatcgcttttaatatttcggtttctttatttgggggaacaacgcctttggtaatggcgtggctcataaaaacaacgaataaccagatggttcccgcttattatattatggcagcctgtctcattggtgtcttgacgatgtttttcgtaaaagatacgaccgggaaagcactgcggggatcggcaccggcagtagaagaaaaacacgaaattgcaaaaattctcgaagacccccatgaagcattatggtggaaagaggaaaaaggaaatattgaggaaaaagcgtctgaattggaaaatcccaaaaattaaccatgtccataaggccgctttttggctgcccgtaccacggaaccggcttgaatggccttcctcctcttttaagttgtttctggccgtaaaatgccacgtcttggttcatgcatccgcatgcttgcaagtgggtgcatcccccttttctgttaaaaaatatctgagtatttttatttttggggagaatggaaaataagcggtagacaaaccaatttccgtgcggtaaaataatagaaacaagtgttctaaatggccggtgtgaagtttatgattactcatcttgcatcatgtaaagacagaagagttcacagcaccatgatttcagcattgaaaaaaatagggcggatgggagttagccgcacacagggttacatagcggcttccagcaggtgttggatttgaaaaaagcgtcattttgtaatggaaaataaaaaggattcctattatgcaggatccttattttatcaatcaaattaaatttttttactgctaaatagctgagtgattttgacgattccaaatacgacggttgcaaaaaacaatacagatacgatgattgcaagtatcatgccagcccctccttataacggattccgtccatgataaagccaaatattttttcaattttattataacatattttccaatttccccttgatgtaaaaggggatcagaaatccccgctgccccttatgcagttgaaatgcctgaaactttttttgctgacgcccgtataaaaaagtaacaatgatgaggaggggaaagcgccatgtctgaaaaagggtgcgtgaagtgcgggtctaagcaggcggggaaaaaagaagtggcaatgacgggaacaggtctgtcaaaattatttgatgtccagaacaacacgttcattgtcgtgtattgcaaaaactgcggttattcggagttctatcataaacaaacttccaccgcctctaatattctggacttattcttcgggggctaaatccggggaggtgttatattggaaacgaagctgattatcatacggggaaactccgggagcggaaaaacaacgatcgctaaaaggcttcaaagccatttggggccgggaacgcttcttgtttcacaagatactgtccggcgtgaaatgttaaaggtgccggacaaagaaggaaacctctccgttgagctcattcgccaaattgcggaatatggaaaagggaaatgcagatttgtgattgtcgaaggaattttaaacaaaaaccgttacggggaaatgttgtcccgtttaatgaaattctaccattcaaaggcgtatatttattattttcgattaacgttttgggaaacagtcaaacgccataatatgcgtttgaaaaaaacggaattcggagaagaagctttacgcgcctggtggaatccgagagacgaacttggggtgaaaggagaaaccatgttaacaaatgatatgtcacaggatgaaatcataaaactgatggcggatcaactggaaattgatctttgattttgtatatcggcatatggtgcatgggaaaagcgaaaaagccatatctcttgccaggaattgaaatgaagaaaacgtgtttaaaggtgatggaatgtattcagatatcaatgaacctcgacaaacattatccaaagatgcaataaaggtttggatcatacgtgaaacgctggaggccggggcaggggttgtggttctcgccgtgctgctttatctcggccaccacttttcctggccggcatggatcggctggatattatacggtttactcgtgttggatataggtggtatgatctggtcatggataagttcgtattttcgctataaaaattggcgttacgatgtgaacgaagaatttttacaaatgaaattgggtgtgctgaacgagaaacattctttggttccgatgaccaaaatccaatcggtggcaaccgaacaaggccccattttaaagaaatacaggctctgttccgtgactgtggacaccatggggacgtcccataccattccggctctgcctaaagaggaggccattgcgttaagaaaccgaattgcgcgttatgcaaaaatcagggaggtggagtcgtgaagaaaaaacggtaccatccccttttgattttgtttcgtatcggtgattttgtaaaaagctatttcatccttttcattatcttatttatcgtaaatgccggttcccgttctcccgtgcttacatatggcagatatttgtttttgctcttttttgcaatcgtgatggtatatcattttttgaaatggtacacacataaatatgcactggatgaacgctcctttcatctgtataaaggcatattcaacaaaacggaacggacgattcctttttcgaaaatccaaaacattaaccgccatacatccttttttcaccggatttttcatgtcacctctgtcagctttgaaacgggtatctccggggatgaagcggccgtgttatttcaagtgatcacccggaaagaagcggaaaaaatcattgacatcgtgcagaatgataagcgtaaaacgtttgaactggatgcggaagaaaaggaacgggtggtccattttaaaccgacgagaaaagatacgttaaaagcaagttttacatctttaagtccgcttgccgtcatcccggtatttttttctttttattcgaatgtggacgatattgtcgatattgataaaacggcgaaagggatgctctcttatataatcggttcctggtggattgtatcgggcattgtcctttttgtggccattgttgcggtggttttcggcatggcacggacctttttgaagtatgggaaatatgagatctcctctgatgaagagcggatttatattaccaaaggggtaattgaagagacgtctttttttatcgaaaagcataaagtgcaggctgttgaagtggaacagtctttgttgaaacggttgctcgggctggcggaagtcaagctgacgagtgcaggaaggcttgactttgaaggagagaaacttgaattaaactcgctgtatccttttttgccggttaaaagggcgtacgaaatcatcaacgagatattgccggactatgaagtggcacaggagatgaggcagctccccaagaaatctttatgggtccggctgtttgccccgagctggatttggatcatcgccacagtcgtgttatatttttggaaaccggaaattttcggcttgcgtgttccgtggtggcttttgtccgcttttctgttcgtatcgatactggtcgcaagatggatcggttatttacatacgaaatatgtattgaatgaccgttttattcagttgcaatcgggcatttttacgacttctttgttcctttccaagcgggaaaaagtgattgaagtgcgcgtatcccggaacttttttcaaaaatggctgggccttgcttccattgaaacgatcaatcgcgcaaaaccgattcaatttaacggggtaaaggatgttcctgccgaatttgcctggatgttttacaaatggtacatggggcggggaaaggaagttaaagtggaatgactgttttggccttcatatgatcacggttttcatgcagtcccggcacatgccgggagcagaggggggatccgattgacgattatcctttggacggccattgtgattttattcatcttaagttttgcaggcatcatctatcctgtcattccatctattgtgatgctgtgggccggatttgcagtctatcagtttttcattaatccgcatgcattgtccgtctggttttggatcagcatggtcatcctaagcatcgttctgattgctgcggatatcattgcaaacggatattttgtaaaaaaatacggcgggtccaaaatatctgaaagggttgctgcggttgcgacaattgttggctcttttgtcattccgccttttgggattatccttgttccgtttgtttgtgtatgtataacggagatcttgatgacgaaaaaccccgtccaggctgtaaaagtgggcgttgccacgatcattggatttctgagcagcagcatcgccaaagcattgatacagatcgtcatgatcgtttggtttagtttagccgttgctttttaacggatttcccgttttcacgacagccggttgcataatagaaaaaagccccgttaacggagcttttttctattatgcttcaagaagatcggcatcttcctgttgatatatttttttatccatttcaccggtaattttgccggttaaaataccggaagtcatggcgccgctgacatttaatgccgtccggcccatgtcaatcaatggttcaacagagatcagaaggccgacaatcgcgatcggcaggttgagcactgacaatacaatcagcgatgcgaaagtggcacccccgccgacacccgctacgccgaatgagctgacaacgacaacaaggatcagcgtaatgatgaaagacgggcttgccgggttgatgccggcagatggagcaaccatgatggccagcattgccggataaataccggcgcaaccgttttgcccaatggataggccaaaggaagccgaaaaattggcgatcccttccgaaatgccgaaatgtttcgtttgcgtttcaatgttgagcggcagcgtaccagcactggaacgggaagtaaaggcaaaagtgagtgcaggcagcgccttttgcacatatcgtaccgggctcaattttgccaggctgatgagcagcaaatgaaccaggaacatgacgataatcgctgtgtaagaagccagaacaaactttgccagtttgacaatggcgccatagtcgcttgaggctgtgactttggtgatcaatgcaagtacgccatagggtgttaatcttaaaataagggtaaccacccgcatcacgatcgtatacaaagtatcaacgatttttgcaaaatgttccgcctgctcaggttgtttgcgttttaccccgagataggccatccccaatatagcggagaagatcacaaccgcgatcgtagaagtcgggcgtgcgccggttaaatccgcaaacgggttattcggcagaaatgaaacgatttgttgcggaatggtcatatcttttacgctggcgacgcttgtttttagttccgcatttcgcgcggcttcagcggtcccctgcgttaagtggatgccatccagcccgtacagaagcgcggatccgattccgagcgcagcggcaatcgcagttgtaccaagtaaaatggcgagtacaagaaagctgatttttcctatgtttttggttaatttcagcttcgtaaaagccgctaaaatggaaatcgagacaagcggcatgacgaccatctgcaacagcgaaacatagccgctgccgacaatattcagccagtcgatcgtatggttggtcacatacgacgtggtgccgtacaagaaatgcaggataatgccaaatacgataccaatgcctaatgccgagaaaacgcgttttgaaaacgaaacatgttttctttgcatcgcatacaaaccggccaacaggatgataaagacggccagattgatgataatgtataaaatgttcaattttccccctccttttgttaacctttttcatcttaatcatcttattccgatatgtcaagtgaggtatttggcggcggaatttatgtcccattggttactcgtccgtttcaatctgttcttttctgtcatttaatatattgaaaaaagaatgggaggtgaacagattggaaaaacggcgaaaaaagacaccagtcgtcccttggatgcacgatcactatggtgaggaaacagcgggcaataccagcacaagcaacaatgctgtacagccggaataccgttacgaaaatactggcaatatgaataacgctggcaatatgaacaacactggcaatcaatccaatcgtaccaacaacacggtattttgcgaaccgaagtatgtttataaggacacttacgttgaaagaaacgtcacttatgtgcatcccatcatccaagtaaacaggcaacatgttgtaaacgttccgcgccatgtttatcaaagatatgaacagaacattacggtagatccgggtattccggatgaatgtgatcattgtgatgagtaatgaaaagaaacgccccggttaaagccgggaatttttaagccggatccaatggtttccggctttctttttttaataaggggaagtggcaggctgtttaccgggaatggaggtaaaggggagatacattgaaaaaagataaaaatacattgatatttaataactatttattgtaaaacgataaatactatgctaaaatcaaagcgacaattcatcagtgaggtgttttttttatgaaacggggatctacgctctttttacggctggcagtcattttgattggcatcccaattcttgctttgtgcatctttgtggtgccggagattggaaaactagcagcccacctggttccggattttgcgttcatggcatttctcgtgctgcttgtgatctacggggcaacactccctttttattttgcattgtaccaggctttcatactcttaggtttgattgacaaaaacactgctttttcggcaagttccgtaacggctctgaaaaaaattaaatactgtgccgcagcgattggcttcttatacgtggcaggcagtccgcttttttatcttatggcggatagagatgatgccccgggaattctcgtcatttgtttcttcattatttttgcatcagcggtcattaccgtctttgccgctgtgctgcaaaggcttttgcaggaagcgattgaaataaaaaatgaaaatgatttaacggtctgaggtggaaaatatggcgatcatcatcaatattgatgtcatgctggcaaaaaggaaaatgagtgtgacggaactttcggagcgggtcggcataaccatggccaatctgtcgatattgaaaaacggaaaagcaaaggcaatccggttatccactttggacgcgatatgcaaagcgttggaatgccagcccggcgatattttggaataccgggaaacaatggaggagtgaccatggaggcaaccgttcaaaagcatgttcagaaaaaaacggcaaggctgcgaatgaagcgggcgctcgtccaacttctcttatttgcccgggagcaggccctgtcctgtctgtttcctgttgtgatttttgcgtcattggcgctgacaaaaattgtgccgctcccttttttgccgcggtatgactggctgcttatcatttgccttttcacgcaatggtggatggtgcattcccggcttgaaacagtggacgaattaaaggtcattacattgttccacctgatcgggcttgcactggaaatttttaaaattcatatgggttcctggtcttatccggaaaaagggtatgtgaaaattttgggtgtgccgttatacagcggattcatgtacgcgagcgtcgcaagttacatttgccaggcgtggcggaggcttgaaattaagctcgtaaactggccgccgtttttaatcgtgtttccgcttgctgctgccatttacttgaatttctttacccatcatttttggatcgacattcgctggtggctttccgcacttgttctcgttgttttttggaaatcccgggttacatatgcggtaaacggcacccgctacagcatgccggttgccctctcttttgtactgattggctttttcatctggatcgctgaaaatatcgcaacattttttggcgcctggcaatatccggatcaggcccacgcctggagccctgtccacttcggcaaggtaagctcctggctcttgcttgtcattgtcagctttttgattgtggccacgttgaagcaggtgaaaggaaataggtcaggcggggaaaagacggagcaaggctggggaaattgaagcggaaatcaatcaaaaggatttcaggaacattttttagcccccgatcaccggctgtgcttaaaacatacaaacgtaagctggatcatctttaagcatttacctaaattgttaaatttgtgattcacatccatctccaaaaaccatcatttctgccgatataaaatggaaagtaaaataaaggcagaaaagaggtaagagaacatgcaattaaccgtctcccgcaaattatttttggtatttggatctatcttgtcactattgatcattgtctcagccggtgcctatatcgggttaaacaagctggacagcacgtatgccaaactgatcggtgttcaaacgaaaaacttggattccgccaaaaatataaagatcagtgtgagggaacagtcagccgcagtacgggggtatttgctgaccggcgaaccggcttatttagatgactataaagaggcaacaaacaactataaagcccaaagcaaagcattgctgcgccatttgaccgacccgtcaaacatcagcaatgtaaaagagcagcaagcattatttaatcagtacacagcaatcttaaatgaagaaattgcctataaacaaaatggacaggagaaaaaggcattgcagcttgtatccacttccgggcggcaaacaggtaaggaactgggcaatcaaacagatgcgcttgtgaaagggatcaaccacgtgctggatgttgaaaagcaaaagactgaaaaaaccgtgcatttccttattttgctgatcagcagtatctcggccgtttccattttgatcggaatcgggctgctcctgctgctgagccgggcaatctcaaggccggtgtgggttgtctccgaagccataaaaaacattgcggaaggccgtttgaatatagaaaaagtggatgtgaaaaataaggacgagctcgggcaaatggccggcttattaaatgaaatgatttcagatttaagaaatatcatcagccaggtcagcgaagcttctgaacaggtttcagcaagcagccaggagctggcagcgagtgccgaacaaagcagccaggtttctgagcatattgccgaggtcacccaagaggcagctgaaaagacggatcacgaaatggtccaaatccagcaagtgacagcaaccgttgaacaaatgtcactggaattgcacaaaatcgccgggaacagcgaagacatggaaaaagcggttgaaattgcaaatacgctgacaaaagaaggggacaaggccgtttcaaatgttcaaaaccaaatgaatcatatcgaaaaaacagttgccaatgcctctgacattatccgcagcctggagaaaaggtctgaggaaatcagccggattatgggaattattacgtccattgcagagcagacgaatttgctggctttaaacgcaacgattgaagcggcaagagccggggaacatggtcagggatttgcggtggtggcaaatgaagtcagaaagctggcagaggagtccaaaaaatcggcggatgaaatacggacgatggtttccaatatccaatcggaaatgacacatgcagtcaaagcgatggaagaaggccatcatcaggtcaatacggggctaaaagaatcttcggatgccggcgctgcgtttatcaaaatctctgaatcgatggaaaatgtgttgggaaaagtgcaggaagtggcagcttcggttgagtcattgaatgaccaaggcgcccaaattacaaaaacgctggaagaactggcggttatttccaccaagaccgctgaagccaaccaggaaagcagtgcagcaaccgaggagcagctggcaacgatggaagaaatctcgtccctctctaacgcgcttgcacatttggctcaggacctgcaagatggcatccagcattttaaattataatatgccagaccgcaccatgaacccctttaaaagataaaagacgggaacctttctgcggcaaaggggcaactccttcttaagtaaaatcgaaaaaggctgcaccaaaagtctgaacgccacaagaacttgggaaaagttatccagacctgtggaaataattgtgtataaacatgcgaattttattctttttccctaaattcaggatgataaacatgtttcatggcatcataataaaaatttttggagccataaaatccgcgcaggctctcagcaccccgtagttatccgtgatgggattgtaaaaaatttcctgattacacacgtttcgaagccggcatcctatgcatgagacgaaagcaaaggagcctggaaatgccaaatactggagaaaaccaaacaaacgagcaacaatacaaaataccggaagcggtccgaaaaagccaaaaccatttcaaaaccggccacgctccgagcaccggcctcgaaacagccggcgaaaacacgccaaataagagcacgaaatagcttcaaaaaacagcctcaaaaaatggggctgtttttgcagaaaagacccttctccgtgtttgaaatcaggaagggaatcaggcggcccatgctgcatcgctttttatagaaaagggcatcggaaaagaaaataacaaatgattgctgtatataaaatgaacaacatttcgcatctttgttgcctaatggaaaaaggagtcatcagtcaacgcccggacttgatgtaaaaactgaagttcattttatatcgccttcattaaaatcaggagtgataaaaaatgaaacgaaaacaccaagtaacattattgtcattagtcactgcaatcggcattgctttactgccatttgccatcgtaaaacgttcctttaaggattggatcattgtttatcttgtcagtgctgcaggaaatttgcttgctgacacctatctggtaaagaaagggtttattcaatacaagatccggccatttcctgataaatttaagatccacttgccctttgatctcgtgcattatccattgctattgctttactacaatcaatgggcgttaaacagcagaccattgagccaaatttttaaagtgcttctgatttccctcccgcaagtcatgatggaaaccatcgctgagaaaaaaacgaacttgatcacttggaggaaagggtggacatggtatcattcttttttcagtatgatgggcaaatttttcatctgcaggctcatcattgcgtttgtgaggaaaatcaatagggaaagggtgtctgtaacctaacaggctgccgaagctttaacggcagcctgtactgtttgggtctacggggcttcccccgtgattgtaagaccgctgattgagcaccctataagtgaagtttgtggctgaggatcggcatgagataagcgggggacattctgcataacgattcatgtggatggaaaaacctcaactcattttatatagctgaacctgacgaatgtcatgcttcttttccactcaaccatcttttcttcaaatcttctatcaacaaatcggcaaggccttcctggtatcctgcttttttctttaaccgcatttcatttgccaccaaaagcagttcaggggattgaaccgcatccagcttggaaagccgggtggatatatcctcttccgacagggtcaaaaagtatgcatccggatccatccgccaaaataccgtttgccccgggaaacggctgctgaggcgctctgccatgacaacgccttccggatcgagatcacccgaataataaaaagtacagccgttttttgcaagatgttgcagcatgatccaggcagcagtgcggaactggccatgcgtgcaaatcacaggcgcatcggacactgcatcaagcacagccgaagcgacaccggaattctcaatgatccaaaccttttttcccgctcgtggccaaatattcgttagctgcaataattctttcactgggacgttcatgaccgtcccagtagctgcggcttcacgccagaccgggtgcagaccgttttcggtttccgccaaaaatgcgcggcatgtcacgaaactccataagtcatcccgcataagcccagcatttgcgtacagttcgttcaattcttccgttgttttcggcacttcttcgatcagcccttttaaccattggtcggtgaacaaacagtggataaagagcttgcccgcgaaacgggtttgatcaaaaaaatgcgggttcccggtaatacgctgggaataaaacggaatccgttcgtatttcccttcttctggaagcatcgtgaaagctttccaaaccattttgagctgtgcggacaacgtatccgggtcctgcttgtatgcatgccagataaaacgcgtgtcagccgttttactggcaatccggcgccaccacccatttccgtccggcatcgtttccgtcagccgtgccaaaaattgttcctctttctttttctcaatttcttcctcttccgctttggaaaaaattctttccttcaaaaccgcttcaagcagttcgacaagggtgtattttccgaaaacagtcggtgccagcgctttttcaaatgcccgcagcgaaattttgtttttctctctgagcaaatcaggggacgtgccggccagcccggcaatcgcctccagttcggtgcgcgtaaaaccggaaaggctgactgttcccccaatatggccgagcgaacggtatttttctttaaaaaggtggaacagtttcagcatccccggttccttccttaacagatcgatcgcatccttcatcatttcaaactccttttctcacgccctaaccggatatctttttgcccgctttcagggaccattttacgccgattaaaagagaccggaatgacttctggcatcccggctacgcacgggtagatgaacgcttttcaaagcagatccggggtggcgcctgccaatgattctttcggcttctctacaatcgaccgtttatgcccatcccaccggtaacggatcactgtcacataattggcgtttttcgggcggacaaggtcacagatggcaagactggatatggtgtcataatcaccccagagcgcctgcgaattcatgatgtaattgaatccaagctgctcgacgacttcgaacatgtcacggatattgttttcatctaccccggcaaacgcttcgtccagcgaaatgatgtacggcgccatactgcctgcctccaaatagcgcgaataggctgctgtaaagagcggaatgtacatggccattgccttttctccgccactgaatttgaaaaacgcggtattgctcagttcgcgtttcggctcgccggcacgtttgtatgacagcacgaattggaaccatttccggtaatcgagcacttcttttaaaacttgatggagcgtcgacccttcattgcggatttcaatcagttctttggcagccgcaatccgtgagcggaaatgtttcgtaatccggttcaaatcgtcctcgtttaaaaacttgctgttgcgctgcagcaacgcgacaagatcttttgtatcgagctcatcctcggactccgccgttttttccttccaggcaatcgaaaaagtaagtccggacgaattatcccggtttctcatgatcgcatccatttcttttacccacttggctgcccgctggatccggttccgcaaaatgacgccaaccgtattgacgataatatcttcgtacagccttctgtcctgctcatccaaataactttgcaagtttaaaagttctttttcaagagactcgagtaccgtatacgggctcaccctgcggccgcggtattccatctggatgaggcggcggccccgcaagccttcccattcctttttgaacgtttcgtaatagtcatcgagtttttcagcgaaccaatccggcgggtccgcttcttttgtaaactcagacatgcggtattctgttaaatttgactgttcgttgaaaaaaacttttgtcaagttttcatttaattttgcgcggtcatacttttccagcacaccagaaaacgccgtcaaaatgctttccggttctgtgtgctcgctctccacgaagccgagggaaagttctgcttttacgagtttctcccattccgccgccatatttgtccaaaacgtggtacgcgttttggcaagagacaaattggtggtgcatttttctagttctgcttcttttttcggcttttcttcgtagatctccctgattttttcctccgtactggtatattcgtgttggactgcctgaatccgggcgcgaacctcatcaatcccctgcaatttcagctgctgctcaatcgcttcaatatttgccaccgttttctcccattctgaccggcggatgttctcttcaccgcgaatttcatcgagttcctgctctttttcaaggatatccgcagcaagacgcgcaagcattttgcgcccggaaaacaaacgttgaaaaatgagctccaggctgtgaagatgttcttcataacttttcgcagctgctagtgcttcatcgagcggaccgctttgaaggacaaggttcaagccggctccttgctcatgcagctgtagccggatgttttgcaaatgctggtatacttgtttccaatcgcggtcaatttctgtcagaaattcctgttcctgtttcaggctgcgcgctgttttttcaatctgttcttcaaggtcgcgtaaatctttgtcatctggaatgcccgctttccaatcttctgcttcttgtactttcctagcccattccgaaaggcggttttcgatttgcaaaagggctaggcggatttcagcaatcgtttgctctgtttcttttattttttcctgctggtaccgtttccgggatgttctgccgatgaatttggaaggtccttcatccggagcatggccaacaaggcagccgactgaaaaagagccatccgcatcaatgtgaaagccgctgtccgacggttcaagcggaatgctgcgcaacacttcgtcaatgcgtgcggctgataccgggctgtcattatccggatccggctttaagtaatcggcaagtgtgtagccgagaatgtgcggatttggacggataacccggtcgtgcacaggtgtaaccggttcttccgtaatcaggctgtccaaaattcccgtctgccggagtgccgcttcaattctggctttttgggcttcggtcacatgatcctggaattccaccgcggcataaaaggggagatagcgtttccctgctccatcgagaccggcgcggaaagcttccgtatcctgagggcgctccggattggcaagtttcaagtttttccaatacataagtgtttcttcggcttcagccaattcctgttcttttgccttttgcgcctgctccgcgcgggaaatttccttctgcacttgcaaaatataatcgtttgccgccttcacaatttcttccctgaccgcttcataacggttttcttcatagagcccgtccagcgcgacggcaatgcgccggagtcgttcgtctgtaaaggggagggccggatgctgttcaatccataaaaacacggcatcttccagttcttgtttttgttcggtaaaccagttctccaaatggtcaagttgtttacggagttcgtcaatttcctgctttttggcagatgactggcgctgcaatttcatatgcatctcgtgaagccgctccgcttctccggccagttgctgcaacttttgcaaaagtccgctgtgctgtttgatttcctgtttccaaacagaaaaatcaaaagcttccccttcatgccgagaaaagtctccggcattgatctcgtgctgggggaaagccgcttctccggcatccagtgcaagttcatccagcgtctcctgcatgctggcttcatccttgctgttttctgtttccaaccggtcctgttccaagcggatgtttaaaagctggcttttctttaattcccactttttctccagatctgctgcttcactttttagcttttcagccctggcctgttgctctcctttttctttttcaaggcgccatacctcatggtgctgcagccgttcctgttccgcttttaaaacgtcgcgtttctgttcgttctgtttttgatcttctgtcaggttttcaatcactccgcgcagggattcacagcgaactgctaacgtaccggcctcctgctttgcttcctgcagcctgctttcggcctcctgccatttttgggcgcgttctgccaaaatatattgattgtaaagatcgtattggcgcaccagtttttttgccgattcgtgctctctttcaagctgttcaagctgctgctccgtttcgtccatgctttcaatcgtgtcggacaaatggcgaagctcgtcatctgtcaaaggtggtaacgcagactcgagaatttcatagatgaccgtcggcttgaaatcctttgacaatttcgggcttctgagctgaatcaaaagcttgatcaaatcttcaaaagcttccatcgactggaaaccaaaaatatatttgttcaccagttccatatattctttctgcgaatggacaagatgccccccagacccgattcggttttcaagctcttttgcagacaacggaatccgttccgattggcgggtgtgtgtcaattcaaaattgtagccgatcctgcggttgtcagtcaggacaaaataccatgattttaaagttttgtgccgctttgcctgcatgccgatccccgttgtgatatactgctttgtcccttgctttcgatattccagaaacaagtagccggtccgctcgtcatggccggacacttctttttccccaagcagataatcttccattttccttgcttttgagccgaatggatcaagccgatcaggcgtctttttcccatccagcaaaaccggcaaaatgctttgcatcgtcaccgatttccctgaaccgtttgtgccgcgcaacaacagctttccgtctgcaaattcaaaaacttcatcgtcataataccaaaaatttaacaagccggcgcggttcatcacccattttccttctgtcacggttcctcatcccctttctcaaaatcagccggatactcgcctgcaagcacgcccaacagcggttttatccggatcagtcccgctgcttcatccgtttccgccatcatccattctttcatcatttcgagcaattccgcacataccgcttttgtaccggcatctcgaaaatgtttcgaccacccgcgttcaaggcgggtgcgcatatcgtctatcaccgcttccaactcgccttccgtaagcaaaatttcccccgcttcattggggacatatttttccggatggtcgtgtagcgtcttagacaactgcagcatcagatccgtggaaccttttgcattcgggtaaacatgatggtaactccgcggttctgcggcagataaaaatgcagtgtttttgaaaacatggagtttataatggctgtgttcttcaatgtcctccaaaagccggttgcggaaattgcggatataaagaaaatcagggtcctgcatatctttccggtgcaggccaggtgagaaaaacaatttccgatacacccgcttacgccgttcatcttcctgattttgtttccagtcttcttcaaggagcccggtccagtccggataacttgtaaaatcatccggaaagcttcttagaaaatagcggctgtaaacggtcgcttcatataggacttcctggtcttcgtaagtgtcgaacctagaaatatcgccgtctattgtgcgaatcagactgaattccatcagagcctggactgcccggatgagcgacttccgatgaagataaagcgtccagtccagctcatcttctacaggataattgttttggatttcctggcacatttccgacaagagaaactgttcatccaccgcttttccttccaaaaaggagagcgcacagcaaaaaattgcataatccatcggctcctgaaaatgcaggatgcccatccagctttccggttccaccgggattttttcgagtttgataaaatgctgatggatgatcagcctaaggccaaatttctcgctgatgtaacggcgcagcactttttcgcgttcgcggatgagctggtaccagtccgggtgctcggaccgcaaaatccaataatgatggaataacaagtccattccctgcaccgctttttcatcaaaaatttgtaacggatccatcagcgctctcctcctgatcgttcaaatacgacatccggcatgatcagtttcccgtcttctgcatcgagtgtgatgagatgatccggattcatcgcaactcttacggtcatcccgtaatccgtttttacctcatggtttttcgctgccattgattttccaatccagccgagcagcactttccggacaaacggttctacggttccaatttctgcaaggcgaatctctccgtttttcatgtatttttcaatcagctgtttttcctgttcgcgctcttttaaataggcgagccgctgtttttctttctgttcatgattagatcggaaagcgcccggctttgttttctcgcggtaccggttcgttcgcggcttgatttgccgcatctccggctgttcttcccatgtctcggcatgaagattgtccgttgtcgcttcctccaggtgcaaatgccttactgtcatcgtcccgaacacgatcgatgacaattgatgggcctcttcaagattgcggcattcggcaaaccatttggccagatgcaaataatcttttttccggctccggaaatgttgctggcgttcactgatccgttgtacataacgggccattctccggatcatctcatttgtttgcatctgcaacatttccaattcactttgggaagagctgcccccaagaaaccaccgccgcaaagacccccagtattcgtggaactcttccagccattcttgttcggaagctgccgtatcttccaatcgcggaatttggcgcctgtgttccacgagtttttcaaaaaacggtgccaatctttgcccatccagttcacgcagtcttcccctgatttgcagggaagttttttgcaacgatacgataaaatcacgcaaataagccgtaaattggtttttatatacgagaaaggcttccgtctgcatccgttgtgacgtcttttcgctgttgatataagcgatgtaatccgccgtattcgtccggatggtcccgaaaaagtgaaaaatgtcatcccaaatatgcatgtaatcggctgcaggtttattcaatggctgttccagttcctcttccagtttttccaaagaggcgagtaggcggtcaaattgcgaacgttcgagcgatccttggaactggtctcccaatttttcaagctggatcagcatccgctcgatttctaccgtgtaaggtgtgcactggtagcggaatctttttttcttatattcttcgattgttttggcattggtcatatcctggcgagcaaccagattattccatttcacaagctgggccaactgctggtgcagctgttcttccgcataatcctggaaggccgggagcgaacgcagatattcgagcacttcctccggtgcaataaagtcgcgcatcctttcatgttgtcgataaaagaagcgcaaaatcacacggtattgggcggccgaatccgccgtcagataactcgcttcgacaactttcttcatgatctgatccatttcgtttcaccacatttgcttgtattacttctattgtataagattcgcaggaattttggcatggaaaatatgtttttgtggttttttatcctggacttaaatatggctgctgccaggtgcatagcatggggggaggggcaagtacaaaaatgaaaagcggaatctttaccggcagcctgtactgttcccgcgctctacgtgaaggaatctgaaaaacggcaagctgtcttcacttttatccaaaaaaggaagcgcatcccaaaaaccagcggtatctacaaaaatcaatagaatgcttccggaaccggtgcgggctgaaatagataaattgaactcaattttactgcttctttatgtgttacaagaatccatgtttatcctgatcgtaatggattttgacgcgaaaaacttaagttcagtttatatagaaaggctgcccggccattacaccgggcagcctgttaaatctgttatgagccggccagaggaaatgtcatgctcggcatccaatttggtacgagccggccagaggaaaattgcccccgcagctcggccgtcactttaaacttcttttgctacggcatgttcatgcaacgccccgtactggcggcggtaacggatgacaaagtacaacagggtgaggatttcggcagctgcgatataaatcagtaggatgccggcgttttgccacatcacgtcgaactctccgctggaaaccaccgctttaaatccgcgcacgctgtaggtcatcggcaacagcgggttaaaccactggatgaatttcggaatgacttccaatggaaaagtccccgcgctgctcgtcagctgcaggattaagataacaatggcaaggaatctgccagggttttgcaaaaacgtaaccaaaaattgaatcagcgccataaaggtaaagcttgttaataccgagaacaatagaaacaatggcacattttttacatgaatgccgacacccgaaaggatgatcacatctgcaatgaccgattgcaggatgctgacaatcaggagtacgcccaatttgctgaaaaaccagctgatgccgtttttcgggatgcctgccgattcaacgagcgggtagacgattgtcaaaatcagtgccccgataaagagcccaagggataagaagtacggcgtaaagccggtaccgtaattcggcaccctgtcgtaatgcgttgtatgaaggttgaccggatcggccatcatgttgtacgttttgttatttgcctggatcttgcttgctgtgttggcagcatcacccagtttgtttttcagttccgccgtcccgctctttaattgttttgtcccgtcagacaaacgaccggaaccgctgttcagctcttttatgccggatgcaagctgcccggatccggatgtgagctgtccagttccagatgcgagctgtccggtgccgtttgcaagtttttctgcgcctgctgtgagccgcgctgaaccagactgcagctcgtttgtgccggaaacgagagaaccggtcccgtttttcaatgcaaaagagccgtttacaagctgtgaagaaccggattgcagccggcctgtgccttctgcgagcgctgatgaaccgtctgccagctttccggcgcctgtggcaagggttcccgccccgctattgatctgtttcaggccgcttgcaagtttttctgcgcctgtttgaaggccgactgccccgtcatttgcttttttcaaattcgggataaactggttctgtaaaccggcagtataggtctgttcgccggcatttaaagccgcaatcccgttatttaagtccacggcgcctgcgtaaagtttgtgcaagctgcttttgactgtttctttcgaaggatccttgtcattttcaatattggcgttcagctctgaaatgcccgctgtaagctggtcaaaagccggattcgtttggtttgaaatgcttgcagcaatcgcatcttcagaaggaatcgcagcttgggctttttgttttatctggttaaatggctcgcttaaccctgcgttgatttcggcttgcaatttatcccgcacgttttgtttcccgctttgaatacgattttcagccgccttcttcatttgtgcgatttgcgcatcgggcaggtttgcttgtttccccaatgtttccacaagttcgtctgtttgtttaatttgttcttctgtcactgaatcggcaatttgggcagccattgcgctgctgatttgggattgcgcggatgttagcccgctattgatttgcccgatgccgttattgagctcggtggaaacgccttttgcgactttgctcggcaattccgttttcatttgcgtaacgcctgcattgagccgtgatgtgccttgtaaaagctgtgccggaatggctgtttctgcttttttcatctttgatgtgagctgactgcttcccgatgcaagatcgcctgcgcctttttgcagttttgtagcgccagacaataaagaattgctggccgttgtcgaaagctggttcaggccggtgcttaaagtggatgtgccggctgccagcttttctgcgcctgaagctgcgtcagaaatgccttttgtaaaagtaatggaaccggatgccagcttttccagatttgctttcaaagcttttgcaccggtattggcttgagccgtcccgttgtttaacgaaactgcgccggcataaagctggactgccccgccattcaatttttgcgccccgttcccggcttttacgatgcctgcctgaagaacgggcattcctttgtttaaagcggctgcgcctgaatttactgcgagcgccccgttgtgtacttttgtgctgccattttgcaatgaagcagctccggaaagcaaccgccccgtcccttgttttaacaccgtgacgccgttatcaagtttaacagcgccctcgttaagttttgcggccccggtacttgcggttttaaagccgcccgccattttttcggccgtttgaaaaaccgattccgcatatgtttttgaaatttcgtccgccattttttcttttactttcagcatggccgtttcgccgatttggctggacaggaagttgtagctgtcatttggcatgtactgaagttgaagtttttccggatttttgtccaataaagtggtggcgcttttggagaagttttccggaattttgatcaccatatagtattggcggccgcgaagcccgtccattgcccgctgttccgatacaaaatggaaatcaaagccgtcgcttttctttaagttcgaaaccagatcttttccgagtgtgagctgctgtccatccattttcgccccttcgtcctggttgacgaccgcaaccggcagctggtccattttggcatacggatctttaaatgcccagagaaacatgccggcatacaggatcggcgccagaatgacggcgatgagcggaatcaggactttcggttggcggataatttgtttcagttcttttccaaataaagtatagccattcattttgaatgcctccgtaaatagatgactaaattggtcatccggtcattttagggtaaaaaaataatgaagaaaacgaaaaaacatgctgtcatagcgttctgcttccatggctgggcagcgcatcagatggcaccctttgcgttcatgagcacacatggctttctgccgataaacctttaaaaaaatacagttcaaacagttttgaaatctcttctttcgacaggggaggatgatttttctcccagtcaaaaatcagggcaatatacattttaaacataataaatgcggttagttttggatcgcatggataaatgtcgcccttttgcaccgcctccccaatgtactggctgatatagttcagaatggattcttccacgtggtggagggcatccactacttcgggtgtgccaagattgacttcctcgtacaatttgatggcgagctggtgcttaaaccggaactccagcaattggtacagcacgtgatggacgttttcgtgaaaagaataacgcgcatcaatcgcttcttcggctgaatgtttcatttcggcaatcaggctttccataatatattggagcagttcttctttgtttttgaaaaaagtataaatcgtgcctttgccgacgcctgcccttcttgctacatggtccatcgtggtcgccttgtagccaaattcagaaaaagatttcgcagctgcttccacaatcagttttttcctgtctgccattgcaaccccctcccttttttgaccaaatgaatgatctggtcaagtagtatataaacggcaaaaaaataacggtatgaatccgctttccgtttttagtataccagatagtggctaaacttgcatgtgacaatttttttaattgccgtttttttggctcccggataaatggccttttatgacaatttatccggggaaccaggattttcgggcttgatttacttgaaaaacaacttttaatttcgtcaaaattgccggcgccggctggattgaggttgtgtgatttatttgaaaaacagcttagaaatctccgctcggttaaagttttacaagccggtgttggtctccattcgtttgaaagcagcctttaatccaaaagggggccgtctgatgccggcaaatccggatcgatgacttggaacggccgcatcatatcgtagtcttcgtgttcgagaatatggcagtgccacacgtagtcgccggcatacggggaaaaccgcatcataacgcgggtgatctgcccgcccggtgcggcaacggtatctttaaagccgcgttcgttcggttccggcggggtggcagggccggtgtatacgatttgacccgtttcgttatataaatctaagtcaaatgggcggcggtccaaaatttgaaactggataagatggatatggatcggatgggtaaaagccgttgtattggcaagcgaccagatttcggttgtgccgagccttggtgtttccgtgaccggatccatccatctttttttgtccagcagcaacagcgggcgcccgtatgaatcggttgcaccggttagttttaaatggcggatggcgcttacgttatggctggaaggaaccgggatggaagataaagaccgcggaatgcggcttgtgtcttctccggcaaccggcagcacaactctgaactgcatcacatcgccggtttggtcggccggatcggcatttggaccgaggtcattttttaaaagaatcgtctgcccagcatattcggaaaaatcaaggatcaaatccgcccgttctgccggttccaatgccagattttcaacttgcaccggccgcctgagcagcccgccgtccgtaccgatctggtaaaaagcctggccggaatcaaggtataaccgataggcccgcgtgttagaggcattgacaatccggaaccggtattttcgcggttccacttccaaatagggccagactttaccatttacaagaatcgtgtcgccgagaaaaaacggcacgacagagggatccggtgtttcgggtcccggattttgcggctggcgcggataaaaaagagatccgtcattgttgaaagtccggtctgtaagaagcagcggaatttcgtacttgccggatggcagatggaaagccttttcttttgggtcgcgaatgatatacatgccggccagaccagcatacacattgaggcgcgtaatgccgatcgcatggtcatggtaccacaaagtggcgggacgctggctgtttgtgtattcatacacttcttttttaaagtccggcccggttttgttaaaatcgcgtgtaaaccaggcttccggatagccgtcgctgtccggttcagtttccccgccgtgaagatgcacaacagtccgcacttccggaaagtctgttcccatctcgtctaagatggtggtgtccatcgggaggaaatgtctttgcggcaaatgatttgtccatttcacccgtatctttttcccgtgtggtacgtcaaaaagcggcccgggaaagctgcggttgtacccccataatcttgtcggccttaaatcccggtgcagcttttgccaaaattcttccattgtgacttcataatatgcgatcccgccctcttcccgcaccggtcggattttttccgcgagcggcaggcggtcaacaaacttttctaaatttgggctcaaactccccactccctcatcaattgatgccgtgcatttctaacagaatatgagccatcaaggcttttggaaagggcgaatggtaccggaggcgaagataacgtttttgcctgaatttggccgccgtgtcaaaagcataggcatgtttgaaaaatggttgagatgcgagggtatgtgtaaaattttactcgaaggagcaaatgaatggaaaaaaatgggaagacactctattatctaaatgtacacagctagatgaacatctagagagagatcttcccatggatatgatatcaataattgctggatgattaaagggtacaaagagtcttattgaatttgaagaacaggttaaaattctgatgcagaaggcttttacccaatgagttgaagacgtcaaaaaattgaacgttcacagtaaaaaacatataataacctatattggtttccgagacagtaagaaaagaaggtggcacaaatgaaaaaaattttgctcttggcaacaggcgggaccattgcttccgtcgagggggacgaagggctgaaacccgggctttcgggagaagacttgctgaaatattttcagcgtgctgctttgtctgccgatgtcaccgcaaagatattaatgaaccgcgacagcacaaacatgcagccggaacattgggtgcaaattgctgaagcagtcgcggaacattacgaacagtatgacggctttttgattacacatggaacggatacattgggatacacatcggcggccttgtcgtatatgctgcaggggctgaataagccggttgtactgacgggttcacaggtgccgatcagttttaaaaagacggatgcgaagaaaaatcttttcaacgccctccggtttgcttgtgaggagattggcggcgtttttgtcgtgtttgacgggcgcgtgatcattggcacaagggcggtgaaaatgcgaacgaaaagctacgatgcgtttgaaagcatcaatcatccgtatgttgcttatgtaacaggggacgaggtgcactatcattggaggccgtcaccctcggagcagccgtttcatattgagacaagtctgtcaccggatgtctttctcttaaaattgtacccgggcacaaagccggagatctttgattttttaaaggaacattaccgcggggtgatcattgaaagtttcgggaacggcggggtgccgtttgaagggcgcaacttgctgccgaaaatcaaggaattgaccgatgccgggattgctgttatgatttcgacgcaatgcctggaagaagggcatgatttgtatttgtatgaagtcggaagaaaagtcgcgcaatatccggtaattgtttccggggatatgaatacggaagcaattgtgccgaaactgatgtgggcgctgggcaaaacggacgatcccgctgaagtgaaaaagatcatcgaaacgccgcttgcttatgatttgtcacgggattgggggggaagcgctccggaaaacggctgaaagattgcaatcgccgcttgcttggatttggcacgagattgggaaaacggttgaaagattgcgggaggggaagtctttagttgaatgcattttagcatcccgctggaaagcccttgttcgcagcgttttcccggcatttttttggccccaattttgtgcggattttcacgtatcatccctccacgctcacttttggcaaaatggagattgcgcttcacatagaagcgttctatgtgaaggaaagccgaaaattggtgctgcttccttcacatagagtcgctctacgttaagcaaaggcgaaaattcggactgcttccttaacatagagtcgctctacgttaaggaaagacgaaaattcgtgtagcttccttaacatagaagcgctctacgttaaggaaagccgaaaattggtgccgcttccttaacatagaagcgttctatgttaaggaaagacgaaaattcgtgtagcttccttaacatagaggcgctctacattaagcaaaggcgaaaattcggactgcttccttaacatagaggcgctctacattaaggaaaggcgaaaaactggaccgcttccttaacatagaggcgctctacattaaggaaaggcgaaaaactggaccgcttccttaacatagaggcgctctacattaaggaaaggcgaaaaactggaccgcttccttaacatagaagcgctctacattaagcaaaagcaaaaatttgggtgccttcccgaacttagaaacgtcccgcgttaacattcgatgaaaatatcatcgctttttacataggactgcactatgttcatttttcacaaaaacacaggccttttctgcgtttgcaaaaaccgccgtcataaattccattaaatttcataccaactgtgcggggaatttagtaaactggagttaggaaacattgaaaaatagatgctatataaaatgaacaaaatattaccgctctcttgcctaccgcaaaaagtagtgctcaaacaaatggatgctcgggctatatgtaaaaacttaagttcattttatatagacttttatcacgaacttcacggtccagaccggccaaattgttaggaaacattgaaaataggcgccagatccggccttgagaagcagtttccggcattcacgaggggggggagcgcagtggaaaagtcatttgaaatgttgctggaaatatttgagagggctgcccttttattaacttgcttattttttatcacgcgaattccgcgttttaaagaaatttttcaacaagagcagccgtctgtttttgaactgagttttatcactgccgtcttttgcagttttgcaatctttgcgacttactctggcattaaggtggacgggtcgcttgtcaacgtgcggattattgctatcgtatcaggcggcatcctgttcggcccgtgggttggcattatcacaggcattgtctccgggttgcaccgttatttaatagatattggcggggtgacatccatcccgtgcttgattacgagtattacagccggcgtcatttccggcctgatcagcaggaaagtgaaaaattcctggcgctggttcgtcgggatcgcagccgggatgttttgtgaaatattaaccatgcttttgattcttgtttttgcccacccgttcagcaccggtgtggatattgtgtccaaaattgccttcccgatgatcgcgggggacgtcaatatcggattgattgttctgctgattaaaagcgtggagggcgagaaggaatttgtggcggcaaaacaggcgaaactggcgcttgatattgccaataaaacgatgccttatttccgcgccatcaatgcagaatcgttagaaaaaatctgcgccattattaaaaacgagattcgcgccgatgcggttgccatcaccgatacgaaaaaaatcctggcttatgtcggattcgggcaggaaaggtaccagatcggtcatgaaattatcagtgatctgacaaaaactgcgatcaaaagcggggaaatcacgatccgcaaccatatccaagaccagcagaccccgcagatccagtgcctgctgattattccgttaaaagagcgggatgaagtcaccggcacattgaaaatttattataaaaaagcgaacaaaatcacctattccctgcagacaatggcaatcggccttgcccagatgatttcgacgctcatggaaatttcgcgcatcgaagaaatcaaagaagaagccaataaagcggagtggaaggcgctccagacaaaaatcaacccgcattttttgtttaatgcgttaaatgcaattgcttccacgacccgcagaaatcccgataaagcaagaaaattaatcatgaacttatccggttttatgcgttataatcttgaattgaccgacgattttattgatattaataaagaactgcagcaagtacgcgactatattgagattgaaaaagcgaggttcggcagccgcctgcaggttgaatatgagattgacgtcgtatccgtgctgatcccgagcctaattatccagccgcttgtggaaaatgcgatcaaccacgggattttaaaagtaaaagggccaggagtcgtaaaaatctccgtcaaagaggcaggagataaagtacgcatcagtgtgacggatacaggggcaggcattccggaagaagtgattgagcatgtttatcaggataatatgccggtcacacagattggcctttataatgtccatcgccgtgtcaaactgatttatggaaacggtctggtcattagaaggctgaatcccggaacagaagtttattttgaggttccgaaggtgggagaatatgaaagccattatagtggaagacgaaataccggcacgtgaagaattggcgtatttgattgaaacgtacagtgagattgaaattaccgattgttttgaagatgggctggatgtgttgaaatttttgcaggaacatgaaacagatgcgatttttctcgatattaatattccttccctggatggcatgctgctggcaggcagcatcagcaaatttgcgcataaaccgtatattatttttacaacggcttataaggaacacgccgtccaggcttttgaactagaagcatttgattatattttaaaaccgtatgaagaaaaaagaattgccgccatgttgaaaaggctcgaggctgcgtataaaagagagcattcattgctgggggaagaaggggctgtgccgcgaaacggcgggctgcaccggaaagagcgggtgaacttgcgcaagggcgagaaaattattgtggcggatgcaaacgatattttttactgcgccgcccaggagaaaatcacgcttgtttatacacaacaggaaacgtttgaaatgcccatggcgatatcagagttccagtctcttttgcctgaggatcttttctttcgctgccatcgttcttatctagtgaatttaacaaaaatccgggaaattgtgccgtggttcaatcaaacgtatttactccgcttaaacgggatggatgcggaaattccggtaagcagaagaaatgtgaaacagtttaaagcgctgatgcatttttaaacgaaagtgaaaagcggccggcatgaacacgaaaagtgcatgccggcttttcctgtttttccaggacgggcgtgacaaaattagcatggtctgttttgcgcactgcggccgttcgcacgtgaaaagttagaatgcctgctttccgataggccatcctccaaggggttgcactgaaaaagcggttatggcttgcttccggtcataccgtttgcgcataaaagttggcatgtctgcatctatccatatgccatcttgaatggacatatagcgcgaaagtttcaggaagcggttggtcctatgccgtccattcctttttgtataccgtttattcctttttaaagcattctcgttccgaaaatgcgttccctccttattttcgtactataatttgagctgtagaaaaggacagaagaaacgggaggaaccggacatgttagaacaaaaagcaaaccgcagcctgattgtattggggacgatgattgtgcaaatggggcttgggacggtttatacttggagtttgtttaaccagccgcttgttgataaatttggatggcaattgagtgccgtatcgacgacattttccattttaagcctggcacttgcggtatcgacgttgtttgccacaaaattacaggcaaaatggggtctgcgccgcttggttgctttttccggcattttgcttggcgcaggattaatcttgagtgcatttgcacctacactttggatgctctatctgttggcagggcttatcgttggttatgctgacgggacagcttacatcacgactttatccaatttaatgaaatggtttccggataaaaaaggcctcgtttcaggcatctccgtcggggcgtacgggactggcagcctggtatttaagtttataaacggtgccgtcctcagttcgtttggcgtcacacaggctttcctttgctggggagtgattgcgattgtcatgatcaccggcggatcttccctcttgaaagaagcagaaaatgtaaccacatccggtactgtatccaaacaaccggccggaaaagattttaccatcaaagaaatgctcaaaacgaaacaagcttaccttttattcattgtattcttcactgcatgtatgagtggtttgtatctgatcagccttgtaaaagacattggcacgaggcttgtcgggctggatgttgcgacggccagcaatgcagttgcactcattgccgtttttaacacaatcggacggctcattctcggcggtttatcagaccatgttggaagaatgaaagtggtatcagggacgctgcttgcaacggccattgcggtttccgttttaagctatgcccacttaaatttcgccttgttctttatctgtgttgcagcgattgctttcggtttcggcggaaatgtcaccgtatttccggctattatttcagacttcttcggtctgaaaaatcaaagcgccaattattcagtgatttaccaagggttcggcatcggcgcattatccggatcggtcattgcttctcttctcgggggctttatgccgacattccatgcgatcacgattctctgcctgatctcttttgcgattacgcttttcattaaatcaccggctgaagaagcagcccgcacacacggggttcgacggagtgttggtcgtgcccagcattcgcattaaagctggctgtgcgcttcaattatgaacaaacagcttgtatgaaaagaaaaagggattcgtgcttgaatcacggtcctgacggataaaaaacccgctggctgcccagcgggtttttccggtttatccccaaattttctttgcggtatccacaatatattttactttttcccactgctgttcttctgttaaaagattgccgtggtgggtggaggagaagccgcactgagtgctgatgcaaagctgttcgagcggtacatacctggatgcttcctgaattcgttttttgatcagttccttatcttcaagttcgccctttttcgatgtaaaaatgccaagcacgactttcggtccgccttccggaatgtattttaacggttcaaatccgccggaacgctcatcgtcgtattcaaggaaaaacccgtctactttttcgtttgcaaagattttcggggcaattttatcatatgggccttcaaaagcccatttcgactggtagttgccgcggcacagatgggttgtgatggtcaggtcatcgggcttaccttccagtacgctgttagctacatgtaaagcgagatcaatcaatctttccctcttgaggtcactgtctgtaaacggcagtttcggtgcacacaggccggcaagatagacatcatccagctgtaagtagcggcagccggcatcataaaaagctttgatcgcatcccggtaagtttggataatatcatttgtgtattcttcaagatccgggtaaatgtcttcattgcggatcccggcattgaaaaactgattcgggcttggaatggtcattttcgcaatcgccctgtccccggcgatttctttcagcgcaataaaatcttttatgtgcggatggtccgggttaaaggagatttttccggttacccggacgtcataagcttctgtttcaatgccaacaaaccggtatccatggttcggtacatacccttccaccccgttcaaatgctccatgaaatccgtatgccagaatcttcgccggaattccccgtccgttactgcttcaaggccggcttcaagttgtttgtcgacaagccggcggatttcttcattttcaattgcacgcaagtcttccgccgaaatggtgcccgctgcaaatttttcccgcgcatcgtgcagccgggccgggcgcaaaaaacttccgacaatgtctgctctgtacggcgcttttgttaatgtttttgtcatcatgattccctctttctgcatatttttttaaacagctgctgtgcgcagaaagaaattgcttttaactgcataggcccatcaaaaaaaaacctcttcggcaataagaagaggtttggattgcaaaatagaaccgtccgctcttcttatcttcaagcaattgctttctggaattggcacagttctttaaaaaaagaccgctgccgaggcttcaaagggccagtccctccacctctctggataagaattttaaatattatttggtttaaatacactttaaatgtttcgcccatttttgtcaagggcactcgcattattttttaaaatgggacggaaagattgaaatcaggggcgatgtgaaaatataatagtactaagaaaaacaaggaggggttttatggaggctgtacaatcaaggcctgtgttccagaaagtgcttggcgtctttgctgtttcactgctgtttgcaaccgcgggtttatatacgggaagatttattccgcctgcgctcatgatgccgttgatggtcgcggaaattgtaatggtcattgccgctttctggttaaggaggaaaaagagcgtcgggtatatgttcgtttatgccttcacctttatttccggcattacgacatatccgattgtggcttattatgcatcccaggctggtgcagaagtcgtgctgctcgcttttggttccacgttcggcatttttgccgtgatgggtgtcattggggccgttaccaaaagggatcttggctttttaagcaccgcattgcttgtcgcattgctggcattgatcttcatcggaatattcagcatttttagcccgttaacctcaaccgggatgctcgcgtattccttcattggcgcgattgttttttccctgtatgtggtttttgactttaaccaaatgaagcaccatggcatttccgaggaaatggtcccgcttctggctttaagcctgtaccttgattttatcaacctgtttatttacattttgcaaattctcggcattttgggaagcgatgattaaaaaaaaagaaaacgcccgccatcaaccggcaggcgttttctttttcacatgttggagaataaatccgctctctggcaaagtcggcattttattgagcggcacgcttaaatcctgggccggcacatcgtagtcgatggcattcacaagaaagtcaagggaagcttcgataatttcctgcgtgatgccttcgcccgggcagcggtgcccttttgccgggtctgccccgccctgcggaataaagttgtacaggctgccgtcccagtcgcggaagcgttcagggcggaaaacgtccgggtcaccccaaatggcaggatcccggtttgttccgtacatatcgagcaggacgagcaggccttcgtcaaatggatagccgttccaagtaaaacttttccggacttttgcccctaaaaacgggccgaacgggtaaaaacgcctgacttcgcgtgtaaaccaatcgatgtgttgtttgtccccgttctgtacccagtctcttgcgcgcggatgttcgaacagggcaagcgccgcgaaagtaatgaaggtggcaatggcggtaaccggacggatgacattgatcagttcaacggcagccatttgcgcattgaacctgcggccttgcgcatcttcgtaaaacgccatctcttttaaaggagaaccgtcttttgcttcaattttgccggcccgtacatcttcaatgaccgaccggatccagtcttccgcgctgtttcttgctgtccttcctttccagtgccgtggccctactgctccgaatgcgtataccatatcgatgaattcctgcgcccgtttctcggcttcttcttccggaagcggaacaccggcccatttgcatgcacagcggcaaagcagcagtttcgcctcgtcgaacaaaacaatacggtctttttgctcccacttggggatgcgcgcttcccacgctgcccgaaccatttgtgccaaatgctgctgcgcatccggccccatcagtgataaaaacagcgctttccggtggagatgttcttttccatcgagcgtctggatcgcattttcgccaaacaatgttttttgcacccgtttcggcacagccccgtttcttttgaatttttccgggtcataaaacattttgaccgcttcctcgccgctgatgcacaccgctttttgtccgagcagacgggtttcaaacaaatttgcatggtaatcgtccgtccggtttttaatgtagagatacccttctttcatcaaatcaatggtatcatcaatcgttttttcatttggtatttgcccagccattgttttgctccttttttcatgtgcccgtttttcccggccgctgcgaaaaagcctgctgcttccggaaaaaatttgacacatcctttttttctttttacactttttcatccaaattaaaacattgtacgcaacataatcgaagtttacccgcaagccggggaatttatgccatgtttcggttcgcatgcaaacagggtataaggaaatagaaatgcaaaaggagagggaaaagatggcaaaggaaatcaatgtgggcatcggatttgcaacaggaagaaaaagttttaaaaacgttttaaaaacgtatatgtataacctgaaggaatccgaactgacggaaagcgacaggatcaagctgcatttgtttgttgcctatgatttgcactacgaaaatgcagagcctgaagactttgtacatattgaaacggaatgcatggaagatattgaccaggcttattttatcggggagaaggagacgcgtaaagcaatcgaagaacttgtatcacaaatgggcatgagcagaaaagaagcaggccttttgttcggcgaaggatacgcgtccaaacgcaatatcatcgtttatgaggcgttaaaaagaggcatcgattatctcatttttcttgatgatgatgagtatccggttgccgtgacaaaaagcaggaaaacggctgtctggggcggccaggaagtgctccggaagcatttggaacatatccggaatgccgatattacgaacggataccattgcggctacatttccccgattccattcatttctttcaatgacgtcctgcaagaaaaagatttccgcacgctcattgaggcgctgagcaacgatattgtcaattgggatacgataaaaagcgtgatgaaaaacggcggggtgacttatgccgatacaggtgtgcttgtaaaggatgaagcggaagaagtgccggagatcaacagggcaaaatttatttcaggatcgaatttgacgctgaatttaacagatccggaccgtgtactgccgttttacaatccgccgaatgcacggggcgaggatactttcttaggcacatgcctgacagaccggaccgtgttgcgcgtgccggcctatactttccatgacggtttcggcgcttaccagcatttgctgctcggggtgctgccgaccaatttaagctatattaaagcggatacgaaacaggtcgtggaacgtttttacaaagcatgtgtcggctggatccggtacaagccgctttatgtgtatatcactgacagggaaaactatgatgaaaaaatggcggaagtgcgcgcccgactgaaagagacgcttccgaaagtttgtcgctacttcggacgggacaattttatgaatgtgctggaggaattcgagcagtaccaccgcaacgtcagacagcattaccgtgattttcaggatacaaaagcagcgtggaaaaaaataaccgcacaactggtttcaagagaaaaaaggaaaacagccatttaagccgctttgaattaagcggcttttttgccggttggaaagggaaaacttggccgaatggggaacgccataggaaacccttattgcgcatagccgcccatgccgcaacaaatgcgaatcagccagtgctaatttgtccacgggcacttttgtttgaaggtggatgaaaatacatggtaagggttggttgtacacatccacttttttcaggtccaaagacccgggtaaatggtcccttattcatgagattgtcactctgttgcctgctgcaaaaatttatcccaattgatgcctaggcaagatgcaagaatttcagtttatttttatagcatcatgtttaattattggtgtatggggtataagaatggtattcttttagaggcggggccatttttccctgtcctggctgcgcttcggacaggccgcaaaaaacgcgggcggccgccgcttcaacagccatccttttatcataatagatgaggtgtggagaaatgagatcgattgtaaatgaacaagaagaaattatcgcataccttaaaaaaaatagaaacagcttcgaacagaagttattaaatgaagctgtaaatgttaaggataaaattgatgaaattttaagaatagggaacattgatttgttgaacaatgcttttaaaattgtgacgtatgtcgtcgagcagcaggatgaggaattggtcgcctttgcccgccaggaagggattgcctgggcaactcattctttgacgctcggactgaaactggagtgggtgcaggcgatccgccggacattatgggtattccttagaaagtacggggaagaaaaagggattgaagtagaccaggactacttttttgacatggagaaaaaaatcaatgaccgtattgaccaatttttaaatcacttttttatccggtattctacctataaagatgagctgatcgaccagcaaaaaagattggtggaaaacctctccgtcccgatcattccaattacatcgagcgtctgtattttgccgttaatcggttctattgacatgttccgcaccaatattttggaagaaaaagttttgcttgaggtggggcggctgcatatccaaacgttgatcatggatttctccggcattgcagaagtagagatggatgtagtcgaccatatttttaagatgatagacggcacttcgatgatgggatgcaaagtggtcatcaccggcttgcgcccggaaattgtaaggcagatggtcacaaggggcctttcctttgaaaataaagcagagacaaaagtgacattacagcaggcattgaaaaaatatattcagtatgatgatttaaacaaggaaattaagctgtattaatagtgatattatagaaaccatcaaaaaggccctgcactttttcaggcggcagggccttttttacggctgaaaacttaaagcgtctaggatccggttacgggctttgcgccgggcgcccgcaatttcccataagttccgcccggggaaaatgcatcgcctaatggtccgttccgcgggaaaggaaagaccaggctgccccacgaagcttttccgggccgctacaagctttgttcccttgcctggacggtacgtgtttcttttgtacggtgttccagccggctgaataaaagcccgatggcggttccgcacagggctggcactacccattcaaggccggcggaggcaagcggcagtttttgggcgaatgccccgataaagccaagcgggacgccgaatcctttcagcccttcgattaaagcaaacacgcctgtaaacaacaatgcaaagccgtatactttcttcgagccgcagaacgccgtgtggaaaaatgtcaggacaacgagcatgatcgtaaccggataagccatttccaaaaacgggacagaaaattttaaaatggtattgagcccgagattggacagcgtaaagccggtaagggtaacggcaatgacaacaccatggtagctgaatttcggcaccagattggaaaaatattgtccgcacgctgtcgttaagccgacgacggttgtaaaacaggccagcataaagataaaaccaagcagtatttttccagcctgcccgaatagcaaggaagacactgccgtcaggacatcggtgccattttggaacgtgccgcttgaagccatttttgcgccgatcaatccgagtgcgacatagacgagtgccaaaatcgcgccggcaatcaacccggcttttaatgtataggccgtcatttgtttccggttagcgatgccgcgatgtttgaccgctgttaaaatgacgatgccaaacgccagggaggcgagcgcatccatcgtggagtatccgtcaataaaacctttatagaaagaaccggtctggtatccggctagcggcgccgtaaacgggcggccggagagtttgaagaaaccggctgcgcaaaggacggccattgccagcaataataccggtgtaatccagcgcccgagcgtatttgacattttgtcaggatttaaactagtcaaatagacgagcaggaaaaagacgacgctgaacaacaataaagagaccggcgaactgtgggcggacccggaaagaaacggtttaacccccatttcataagcaacgtttgcatttctcgggatcgccaaaaacggcccgatacataaatagacaatcacggtaaataccgtactgaagaccggatggacacggttcccgatcgcctggatgccgccgtctacaaacgaaactgcggcgataacgagcaccggcagcccgactcccgttacgataaaccctgccattgccggccagtaagacgatcctgactgaatgccgagaaaaggagggaaaattaaattcccggctccgaaaaacatggaaaacaacataaagccgataaacaatacttcgtttcttttcatcctatgtccgcttcctttcggtgcaataatgtagagaaaaacaaaaaacccgcccctgaaacagggacgagtttgctcgcgttaccacccttattccgcacaaaaacgtgcggcacctcattcaacgtaccaacatacgtgttcctttcttaacgggggaatcaccgtcaaagcctactaaaaacttcagctttgcatctcggggatgatcttcggaatggccttgaacattggctttcagcaatatgccaactctctggggaacaagatccaaacttactcttcccgtcctcgacttttgtttttcatattatttgaaaataagattatcactgaacatttcatctgtcaacatctctttcggaaaatttttaaccccgtgcccgcgatcaaaatggacagaagccgcaaaatgatgccgtttttggataagtcaaaacccggccaatacaagcgtgatctaaaaataagaacggccgagcagcaagtagaaccagctaaaaaatcaggagtccatcctgagcaattcaaaaaatgaaaaaaagaaaagtcaataaaatcaataatgaaagcgtttccaaatagattttcaaatcaaaattgtcaaaaaagttgacagaaaagggttgacctcggcaatcaaaagtcgtatgattgacaacaattaaagaatataaaaaattttttcgggcggatatttaaagaaccggattttcaccgggcataagaaataccccgcaggcaatagaatgggagtgatggaatgcgaagtgacatgatcaaaaaagggatcgaccgtgccccgcaccgaagccttttatatgcagcagggctgaaaacggaagacttcgacaagcctttcatcggggtgtgcaattcctatattgatattatcccggggcacagacacctcaataagtttgcggaagtagtaaaagaggcgatcagggaagcgggcggtgtcccgtttgaatttaatacgattggggtggatgacggcatagcgatggggcatatcggcatgcggtattcgcttccgagccgcgaactgattgccgacagtgccgaaacggtcatcaacgcccactggttcgacggggtcttttacattccgaactgtgacaagatcacccctggcatgctgatggcagccgtgaggacaaatgtgccggcagtctttgtttccggggggccgatggaagccggtatggcgccggatggaaaacaattgtcccttacatcggtatttgaaggcgtcggcgcccataaatccggaaaaatcagttatgaagagctgaaaatgctggaaacgagcgcctgcccgacatgcggatcgtgttcaggcatgtttacggcaaactcgatgaattcattaatggaaatgcttggcctgacgccgcccggcaacgccaccatcgttgccacgtcggaggaacggcaccgcattatccgggaagccgtcgggcacttaatgaactgtattaaaaacgatatccggccgcgtgatattgtcacagaagaagcgattgatgatgctttcgcgcttgatatggcaatgggcggttcaaccaataccgtgctacatacgctggccattgcccgggaagcaggaattgactacgatttggaacggattaacaaggtggccgaaagagtcccatatctggcgaaaattatgccggcgtcggattactcgatgcacgacgtccatcttgcaggcggaattagcgcaattgtccatgaactttgcaagattgaaggggcgattcaccctggccggctgacgatcaccggcaaaagcatttatgaaaatgtgaaagatgcggagatccgcaatcctgaagtgatcaggccgaaagaaaatccttacagcccggtcggcggtttgtccattctgtatggcaacattgccccggatggcgccgttatcaaagtgggagcagtcgacccggatattcacacctttaccggggaggccattgtattcgagtcccaggaagaggctcaaaaagggattgacagtggccttgtccgtgaagggcatgtcgttgtgatccgttatgaagggccaaaaggcgggccgggcatgccggaaatgctcgcgccaacatcctccattatgggccgggggcttggcaaaaccgttgccttgattacggacggcagattttccggcgcaacccgcggtatctgcgtcggccatatttcaccggaagcggcagaaggcgggccaatcgcacttgttgaaaacggcgaccgcattacgattgatttaatcaacagaaggattgagctccatgttccagatgaggaattgcaaagaagaaaacaaaattgggtgcagccggagccgaaaattacaagcggctacctggcaagatattccgcactcgtgacttccgcgaatacaggcggggttttgaaaatcggattaccgcaaaaaacgttgacggggacaaagtgatcggattaggtatttttcagagagccggggatgctgggagcccggtaaataccccggtcacgacatcgcctctgagtgcaagtctgaacggttctgcctactaggacttgccgggtcggccgcatgaagcggaggacccgttaccaaaagcagcattttttaaacaatgctgcatgaggcggcgtttgtgagaacgccgtgaagttgggtggtaccatgaaaagatgccttttcatccctgcaaaaccggcaaaaacgattgttccttttgccgttttcaaggagagaaaggcgttttttattgggataaatcaaggagcctgcgcaaatcagaataggaggttaaatcgtgtgtgcgaaagcaagaatggatggcaatgtgaaaacagcagaatgtacgggtgctgaggcgcttgtccagttattggtgcgggaaggggtcgatgtcatgttcggctatccggggggtgcagttttaccgatttacgatgccctctacaaccagccggtcaggcatatcctggcccggcatgagcagggggccattcacgcggcagaaggttatgcgcgcgttagcggaaaaccgggtgtcgtcattgcgacttcgggccctggggcaaccaacctgatcaccgggattgccgatgcgatgatggattcgcttccgctcgtcgtctttaccggccaggtcggcacttccgtcatcggctcggacgcgttccaggaagccgatgtcatcggcatgacggccccgattaccaagcacaattaccaggtaagggatttgcgggatttgccgcgggtcgtcaaagaagcttttcatattgcaaaatccggccggcctggaccggtggtggtcgatatcccgaaagatatccagcagggcacggtggaaatgggagaaagccgggaagtatatctgcccggttaccagccgaatacaagcccgaatccgctccagattaaaaagcttgtggaagctgtctcttattccgaaaaaccggtcatattggcaggagccggaatcctccatgcgaaggcgtctgatcttttgctcaagtttgcggaaaagtgccagatcccggtcgtaaacacgctgctaggccttggcagttttccgttccgtcacccgctttttctcggcatgggcggcatgcatggaacgtatgcggcaaatatggccatttgcgaatgcgatctgctcattaatatcggggcccggtttgatgaccgtctgacaggcaacttagcccactttgccccgaatgcaatggttgtccatattgatatcgacccggctgaaatcggcaaaaatgtcaaaaccgatatcccgatcgtggcagatgcaaaggaagccttgcagaagatttgttcggaagatttgcaaaatgctggcacggatgaatgggtccgccatttaaaagaatacgccgaaaatttcccgctttggtacgaagatgatggtgaagaattgtccccgcagcatgtcattcaaagaatccatcattacacaaacggggatgcgatcatttcgacggatgtcggccagcaccagatgtgggcggcacagtattacgggtttgaaaagccgcacaagtggattacatccggcgggctcggcacgatgggattcgggtttccggcggcgatcggcgcgcaaatcgcatatccggaccaactggtggtttcgatcagcggcgacggcggcttccagatgacattacaagaacttgccgttgtaaaagaattaaatctgccgctcaaaatatttattgtgaataaccagtatctcggcatggtacggcagtggcaggaatctttctacgaagaacgctattcctattcgacgatcccggtgcagcccgactttgtcaaacttgcggaaagctacgggatcagaggctgccgcgcaacgaacaatgaagaactcgacaaggtgctgaaaactgttttcgaggatgacgggcctgttgttgtcgactgccgcgtgaaaaggcttgaagcggtgttcccgatggtcgcaccgggcaaggggctgcatgaaatgatgggggtgaagccatgaagcggattgttgtagccactgttttaaaccagagcggggtgctgaataaaattaccggcgtcctcgcaaagcggcagtttaatattgacagcattacggtcggacgcactgaaacggaaggcatctcgcgcatgaccattgtcgtcaatgtcgaagacgacaggcaggcagagcagctgacaaaacagctgaacaagctgatcgatgtgatcaaggtccaggacatcacaggccaggcgatcgtctcgcgggaacttgccttgattaaagtattgagcacaccgcagacgagaagcgaaattggcgggcttgtcgaaccgttccgtgcctccatcatagatgtcagcagggaatctgtcaccatccaggtaaccggtgacagcgacaaggtggaggcactcgttgacctgcttaaaccgtacggcattaaagaaatggtccgtaccgggatgaccgcatttctgcgcggctcgcaaaaacaagtaaccgatttaagctcatactcactattaaaataaaaatcttgaacttaaaaggagagaatgaaaaatggcaaaagtttatcttgacaaagacatcagagaagaagcattgagagggaaaaaaatcgccgttgtcggctacggctcccagggccatgcccatgcccaaaacctccgtgataacggttttgacgtagttgtcggcgtcaggccgggccggtcgtttaaccgcgcggaacaggatggattttccgttaagcctgtgaaggaagccgcaaaagaagccgatgttatcatgatgcttctgccggatgagcagcaaacaaaagtatacaaagaagaagtggaagcagggctcgaacctggcaatgccatcgcatttgcccacggattcaacatccattttacccagattgtcccaccggaaaatgtcgatgtctttatggtagcgccaaaaggcccgggacatctcgtcagaaggacatttgaagaaggagccggggtgcctgcgctgattgccgttcaccaggatgtgacgggggaagcaaaagacctggcgtttgcttatgcaaaaggaatcggggctgcccgggccggcgttttggaaacaactttccaggaagaaaccgaaacggatttgttcggtgagcaggctgtcctgtgcggcggtttgacctctttaatcaaagccggttttgaaacgttaacggaagcagggtaccagccggaactcgcttattttgaagtgtgtcatgagatgaagttgatcgtcgatttgatctatgaaggaggtctgaaaaatatgcgctattccatctccgatacggcgcaatggggcgatttcgtctccggcccgcgcgttgtgaacgaagatacgaaaaagcgcatgaaagaggttttaaaagatatccaaaacggcacatttgccaaaggatggctgcttgaaaaccagacaaaccgcccaatgttcaatgccatcaatacacgcgagcaaaatcatccgctcgaaaaagtcggagaagaactgcgtgatttaatgccttttgtcaaaaatccgattaaacaaaaggaagtggctgtgaatgcaaaaggttaatgtttttgacacgacattaagggacggggaacaatcggcaggcgtcaatctcaacaccgtggaaaaagtcgaaattgccaaacagctggaaaagcttggcgtggatattatggaggcggggtttcctgcatcttcaaaaggggattttgaagcggttgagaaaatcgcaaaaacggtccgaaacagttccgttaccggtctggcgagggcatacaaacaggacattgatgcagcctgggatgcactgaaacattccgccgagccaaggatccatatttttctggccacatcgccgattcatatgcaatacaaattgcgaaaaacgccggatgaagtggcagccatcgctgttgaagccgtgaaatatgcgaagcaaaaattcccgctggtgcaatggtcggcagaagatgcgacgaggtcggataaagactttctcgtccggatcattacagaagtgatccatgccggcgcaaatgtcatcaacctgccggatactgtcggctatacgacgccgaaagaatacggtgcactgtatgactatattcaggaacacgtcccgaatattgataaagtcattttatccgcccattgccatgatgatctcgggatggcgacggccaatacgctttcagccattgaacatggagtccagcaagtggaagggacgatcaacggcatcggcgaacgggcaggcaatgttgccctcgaagaagtggcggtcgcccttcacatcaggcaggattattacaagaagaaaacccgcttgaaattggatgaaatcaaacgcacaagccaattggtcagcaaactgaccgggatggttgtaccaggcaataaagcggttgtcggcgccaatgcttttgcccatgaagccggcattcatcaggacggcgtgttaaaagaggcttcgacatatgaaatcattacgccggaactggttggattctcaagcaaccggcttgtgctcggaaaacattccggccgccacgcttttaaagaaagagcagcagcgctcggctttgatcttgggcaggaaaaactgaacgaagcgtttaaagctttcaaagcattgacggataagaaaaaagaagtgaccgatgacgatttgttcgccattttagccgaaaagcaaaccgatgcggcagatgctgcccattatgaactggaaagtgtgcaggtgcagtacggcacattgaatattccgaccgccacagtaagaatcaaaacaccggaaggaacgcttgttgaagaagccagcaccggatcggggagcgttgaggcgatttaccatacgatcagcaagctgtttgacggcccgattgagctgaaagactataaactgcagtcagtcggttccggccaggatgcgcttgcggatgcatatgtcaaagtgaaattcggggagtttgaatgtggcgggcgcggttctgcccaagacgtactggaagcttccgcaaaatcatttttaaatgcaatcaacagggcgcacgcaatggaacagcaatcgagaaaacaagtacaggtgtgattttcggggaggaacgacaatgaaaatgaaactggccgtactgcccggtgatgggatcgggccggaagtgatggatgcagcgatccgcgttttaaaaaccgtattggacaattacgggcatgaagccgtttttgaaaatgcgctgatcgggggcgccgctattgatgaagcggggacgcccctcccggaagaaacgcttgacatttgccgcaggagcgatgccattttgcttggcgcagtaggggggccgaaatgggatcataacccggcttccctccgcccggaaaaaggcctgcttggaatccggaaagaaatggggctgtttgcgaacctgcgcccggttaaagcatatgccccgcttttaaatgcatcgcctttaaaacgggaacgggtggaaaacgtcgatcttgttatcgtccgcgaactgacgggtggcctctattttgggcgcccgagtgaaaggcgcgggccggacgggaatgaagtgatagacacgcttgcttatacaagggaagagattgagagaattattgaaaaagcattccagcttgcgcaaatcagaagaaaaaaactggcgtccgtcgataaggcgaatgtactggaatcaagcagaatgtggcgcgaaattgcggaggaaaccgcgaaaaagtatccggatgtggaagtaagccatatgcttgtcgactccacctcgatgcagctgattgcaaatccgggccaatttgatgtcattgtaactgagaatatgttcggtgatattttaagcgatgaagcgtctgtgattaccggcagtctcggcatgcttccatccgcaagcctccgttccgaccggttcggcatgtatgaaccggtccacggctcagcgccggatatcgccgggcagggaaaagccaatccgctcgggatggtgctgtcggcggctttgatgctccgttattcgttcggacttgagaaagaagcggcggcgattgaaaaagcggtggatgatgtgctgcaagacggttattgtacaggtgacttgcaggtgaaaaacggaaaagtggtcagcacccatgagctcacagacaaactgattgaaaaattaaataacagtgaagcccgtccacgcattttgcaatgagcgtatttttcaacagaaaataagtagctgtttacggcggtccacacgttttccgggatggaaaaacagtgcagtttttaatcacaggaagaggcgaaacggagattgatctaaaaaaacgaaaagcggcagatgggagtgatacgatggcaccgaaaacgattatcgataaaatatgggaaaaccatttggtccactgcgaagaagggaaaccgaacctgctctatattgacctgcaccttgtccatgaggttacgtccccgcaggcgtttgaggggttacggatgaatggccgcaaagtgcggaggccggatttaacattcgccaccgttgaccataatgttgcgacaacaaagggcagggtttcaaaagacccggtctcgaaaaaacaaatgtccactttggagaaaaattgccaggaattcggcatcccgcttgccggcatcaaccatccagaccaggggattgttcatgtgatcgggccggaactgggactcacccagcccgggaaaacgatcgtatgcggcgacagccacacgtccacgcacggtgcattcggcgccattgctttcggaatcggcacgagtgaagtagaacacgtgctggcaacccaaacattatggcaaaagcgcccgaaaacgatgcaaatcaaaatcaacggaaaactggggccaggcgtgacggctaaagatttaatccttgccatcattgcaaaattcgggattggcgtcggcaccggccatattgtcgaatacacaggtgaagcgatccgcaatttatccatggaagagcggatgaccgtctgcaatatgtcgattgaagcaggggccagggcggggttgatcagcccggatgaaacgaccatttcctttttgcgcggaaggaaatatgcgccgaaggaaaattttgaagaaaaagcggcatactggctctcgctggcatcagacgaaggcgccgtctatgacaaaacgcttgaaatggacgcagcagaaattgagccgcaggttacatggggtacaaatccatccatgtgcctccctatcagtgaaacattgccggatccggctgaaatcaacgatccaggcgaacggcaggcggttgaaaaagcgttgcaatacatgggccttgaaccggggatgaaaatcacagacatccctgtccagcacgtgtttatcggctcgtgcacgaactcgcggattgccgatttgcgggctgcagctgaagttgtaaagggccggcatgtaagagaaggggtccgggccctcattgtgccggggtcgcaaagtgtaaaagcacaggcggaagaagaagggctggacaaaatatttacacaagccgggtttgaatggcgcgagtcgggctgcagcatgtgccttgccatgaatgatgatattgtcccggccggagaacgatgcgcctccacatcgaaccgcaacttcgaaggccggcaaggaacaggcgccagaacgcatcttgtcagcccggcaatggctgcagccgccgccatttacggcaaatttgtcgatgtccggaagctcggacagcctgagccagtccgctaaatggcggcatgccgtgctgcttcttttgcagcaggcagcagaagaaaattcattcatctatacgaagagagggggcaaaagcaaatggagccatttcaaactttttcagggctcgtattcccattggaccggaaaaatgtcgataccgaccagatcattccgaaacagtttttgaaaaggattgagcgccaagggttcggagaatgcttgttttacaactggcgcttcgatgaaagcggaaataaaagggaagattttcctttaaatgacccgaaatacgatggtgcgcagattttagtggcaggcgacaacttcggatgcggctcttcacgggagcacgcgccttgggcattacaggattacggctttaaagtagttatcgcaccaagttttgctgatattttccataataactgtctgaaaaacgggattttaaccgtagagctgccggaagaagaagtgcgtgatttgattgacaaggcacagagagaacggctctttttaacggttgatcttgaaaaacaagtggtattaacgagagaaaaggccatccactttgacattgatccgtatccgaagaatatgctgttaaagggactggatgaaatcgggctgacattattgcttgaagatgaaatttcaaaatttgaagcgtctgaaaacgcaggagtgtgacgagaacaatggggatttcttacaaacgaaagacattgtagcagcatttgaaaatttattgccggtcgtgcaccggacaccgttgaacgaatcggcgacattcaatgaaatggcagggacaaggctttactttaaaatggaaaacctgcagcgcacagggtcttttaaaatcaggggcgcgctgaataagattacgaacttaacaggggatgcgagaaaaaacggcgtgattgcggcatctgcgggcaatcatgcgcaaggtgttgcgttttcagcaacgaaacaggggttgaaggcaaaaatatatatgccggaaaaaacgccgcttgccaaagtattggcaacaaaggcgtatggtgcggaagtcgtgctgaccggcgaatcttttcaggaagcgtatgaagcagctgtattggaccagcaaatcacaggggcaacgtttattcacccgtttgacgattatgaagtgatggccggccagggaacgatcgctctcgaaatgatccagcaatgcgcggatcttgatacggttgtgattccggtcgggggcggcggcttaattgccggcatggcctgtctcctgaaaaattatgatccgaaaatccgcgtcatcggcgtgcagtccgagggggcgcctgccgcctataatcgctttaaagggatgggcaacagccggctcgaacatgtttcgggcattgcggacggtattcttgtaaaagagaccggccagctgacatttccattaatcagcaagtatgtggatgatgtcgtgacagtaagcgatgaagacattgccactgccatcatttatatgcttgaacgcgaaaaaatgtttgtcgaaggggcaggagcggcggcattcgcggctgtattaagcggcaaagctggcgtttcaggaaagcacgtcggcattgttgtaagcggcggaaatgcggatctggataaaatttctcacttcaaacggctggctacggctggcaaaaaaaaacatagggttgtttcgctttagaaccgggcaccagaccggggcatgccgggcgttgtcactaggctgtgccccggggcgccttttctttgtgcaggccgaaaagggagaaaacgatacaaaaaaacagcatcctttgttacactgatgtaggaaagaggtgaagagatgattcaaacggtattatttgatgtggacggcgtattgctgagcgaggaacgttattttgacgcatccggcttaaccgtctgggaattgatacatagtggccattatttagggctcgcaccggaacaatttaaaacaaccttaacagatgaggaaatcaggcgcatccgggctgatgtttttcaacatgatgaagtgctgcggtttttaaaatcgcgcgggatgaacgcgaactgggatatgatttatttaacgttcacctgccagcttttacacttgctttcccaaataaaggaaaaggaagcgggccggatccgcggctggctggcaagtgaaatcggtgatgtaacacttcatgaaatgcgcgaggtacttgcacattatccggttgaaaccgactatagcatctttttaaactggtttgcaaagaggcctgaaacgaaacaggatttattgaaagtgttggatcagcttgcttatgaaatcttcgggcttacagatacgcagcttggtaaaaaaggcgcgctctggtcggtgtgcgagcatgcttctcaggaatggtatgtcggcgaccaaaatattgtggcatctaccgggaagccgagcgtgcaaacgggaaaaaaagggtttctcgatgaggagattccgcttgctgaaccggaaaaaatcggtgccttgttttcctttttagcagagaaagggctgaaacttggtgtcggcacgggaaggccgcagcttgaaacgtacgggccgttccgggcgcttggctggctgccgttgtttcatgaggagcatattgtaacggcggacgacgttttaaaggcggaagaggagcttggcggccatacgccgcttgcaaagccgaacccttttacctacctgcttgctttaaaggggaaaaacacgcccgcccgcgactgtacggaatgcagcctcccgcttgaaaacgggcaggaaatcctgattgtcggggactcgcttgcagacctgcttgctgcgcaaaaaataggcgcccaatttgccggcattttaaccggcttgtccggaaaagaagcaaaagccgaatttgaagaacacggggcagattatatttttgaaaatgtggcagacctcaaaaacatatttttgtagagctggggcatgcgaaggcatgcctctttttcgcaggacattccgctacgtgaaaaatggcattttttgaaaagaaaatttttgtagggaaatctaacatgatcattttattaatatagtgtaattttgccagttcctccataaaaatgaagataaaagtttgaaaaaaatatttttaaataaaattaaaactaacgtaatattttaacatcataaaaaaaggagcggaaatctagatggataagccggcatttgacggaaatcattgaagacggaaactaaaacagaaacggcgattgtaacagcttttaattcggaatatttcaaggagtggaaaagatgaagcaagcaactaaagattatgtcattgatagggcgtataaagcatctgccggggtagcaaacgctgtgctcgtgactttgggtctgggccttttgtttgaaacgttcgggaaattcctcggctgggacggctttttgacgatcggggcagcgacaaaatcgctgttggcaccggccatcggcgcaggcgttgcataccagcttggcggcaatacattggtcattttcagttcgatggcttgtgcggcagtcggcggaaacgcgatcggcacaacccaggacggcttgattacgattgttaccggacaacctgtaagtgctgtgctggctgcagttgtcgcaacgtgggtcggaaaacgcgtaactggcaaaacaaagctcgatatgatggcaattccgtttgccgcgattcttgttggcggtgttgccggcgttggccttgctgctgtcaccacgccgtttttgcaatggctgagcggtgaaattacggcgtctgtacagggttcgccgcttttcggctcaatggttgtatcgctcgtctggagcatcctgctcatgtcacctgcttcttcggccgcgcttgccattgcgctgcagcttgatccggtatccagcgcagccgcactgatcggctgtacggtccagtttgtcggttttacggcaatgtcgctgaaacaaaatgactggggcggcaatattgcacagtcattgattacgccgaaagtccagtttccaaatttggtgaaaaatccgcgccttgtcattccaccgtttgtttcgtcgctcatttgtgcgccggttgcaacgatgatgttccatttgaaggtgccgtatgaactcggcgggcttggcctgaattctttaattgcaccgcttaatattctcgcaaatcagggaatgcgcgtgctgcttgcttatattgcggcaggtgtgattttacccatttttacaacgctcggcatctatcatttcctcaaattgttcggctgggcaaaaaccggagacctcaggatggaagtccaataaaaaccgggttgtacaagcctcattttgacttgtattcgaaaaaagcattcacagcgttttgccgtgaatgctttttatttatacttctacaaaaggttcttcctgaaaggtatagccggttgcgagttccaaagtctggacggctttaatgccgattacctcttttaattggtccagcacttgccggcttgcggttttatcgagcgtgagcaccatgatcgcttccccgccgatttctttccggcccacctgcatcgtgccgatattcgtatcgttgctgccgagaatcgatccgacctgaccgatcatgcccgggatgtccagatgccggatataaagaaggtgctgttccgggcggagatcgacacggtaatcgttcagcttcacgatgcggccgccaaacccgttaatgatcgaagcgccgatattcacttgtttgccttttttatacagtgccagttccaaataattggagaagcccttaaacgccgcattgcgctgcagattgtatgtcaacccctgttcttttaagagatggagggcattgacaagattaacggtgctgccgagatggcgcgccagaatccctttgataatcgttctcgtcagcagttttgtatcttcatccaaaagctcgccggcgtacgtaatttcaattttttccggcgcttcatccaaaagctggatgccgagctgtgccacctgttcgccaagaaggaggaatggttccatccgttcgcggttttccccggaagtttgcggcatattgatggcattgcggatctcctcagattcaaaaatatggatgatttcgtcgctgacatctgccgccacccggacctgtgcttcgcgggtcgaagcgccgagatgtggggttacaataacattcggcagttccaaaagccccggcgtgatttccggctcgttttcaaaaacgtccagggcagcccctgcaacgcggccttcctgaagcgcctgaagcagcgcctgttcgtcaacaagcccgccgcgtgcgcaattgatgatgcggacaccttttttcgtttttgacaaaaaagcttcattgatcaaatgcctcgtttctttcatcagcggcgtatggagcgtgatgaaatcggcttgggcggcaatttcgtcaagcgttgcttttttgatgccgagcttggccgcgcgttcttcggttaaatacgggtcatacccgagcacggccatgccaaatgcttttgcccgtttcgccacttctgtcccgatttttcccgtcccgatgatgccgagcgttttcttgaaaagctcgacgcctttgaacttttcacgctcccattttcctgcggctgcggacttgtgtgcctgcgggatattgcgggaaagggaaagcatcatggcgagtgtatgctccgttgcggaaatcgtgtttcctcccggtgaattgacgacaataatcccttttctcgtcgcagcatcgacatcaatattgtcaacgccgaccccggcccttgctatgacacgcaaattgccggatgcctcaatgatgtcttttgtcacttttgtttggttccgcacaatcagcccgtcatattggccgattgtggcttttaaatcttccggcgcaatgcccggttggtgctcaacgataaaatctttgtgcgcatacagtttttttaagccttcttcgcttactttatccgttactaaaatgttaaacatgtgctttccatgcctcctccgcttttttcaccgcaatgccgaaagtgtcccttccgttcagttcgtgtaccgccatttccagcgcggttaaaacgttgatcacgtcaaaaggcgtgctgtaccccatatggccaatccggaaaattttccccttcaactgcttttgtccgcttgcgacgaccattgaaaaatgatcctgcaaatattttttgattgccccggcttgatcgccatccggtttcaccgctgtaacggtcggcgaagcatctgcgtcgttttcgacaaggagcggaaggcccaaagctttcacgccggcgcgggtcatattgcgcaaaacttcatggcgcttgatgacattgtcccagccttcttcctcaatcatccggcacacttcttctgcaccaaacacaagcgaaaccggcggagtgaacggggtggtcacggcttcatcgtatgaatcgatataacggttcaagtcgagataaaaccgtttctcagggccgtttttgattgcctctttggcccgcttattgacggcgacaaaggcaagccccggcggcagcatgagcgctttttgcgaaccggaaacaaggatatcaatctggtaatcttccatatttgcaggcacaccgccaatgcagctgacgccgtcaacgatatataaagcatcggtcactcgttttacaacggccccaaggtctttcaccgggttcaacaccgatgtggatgtttcgcaataggtggcaaaaaccgctttgaccggatcttttagccccttaaggaacgtttccagctgttccgggcggcaggcggttccccattctatattgaggcggtggacatgggcgccgtatgattcgcaaatggaagcaaaacgctccccgaacacgccggtgacaacgacaacgacatggtcgccttcatggacaacgttgcagacggcgctttccagtgcggatgttccgctgccggcaatgacgaccaccggttcttttgtgccaaagaccggcatcagttttgtcgccacttgcttcaggctatttgaaaagacttcactgcggtgggcgaccataggctggttcatggcctgttttacgcggtccggtacgggtgtcgggcctggtgtgaatagcgattccttacaaaaaagcatgagtacgtcaatcctccaatataaaattaaaataaaacgtccctccgccacaaaaaaatccttgtggaggagggacgtcatgtaccgtggtgccaccctcatttgctgcgaaatgcagcctctgggaaaataacggcatgtgccgggtgcggcctacatcattttcagccggccagttcagaagcgctgggcattgtatcagcaaaagcatcggttcgcagcaaccaccgactctctgcggctttttgcaaatacgccttcttcatcattacttttcgaatatcattttgctctgtgctaaatattctaacagcagattttagttctgtaaagggaaaaatgaaataatttaaaaatcaccgtattttttgattcgcgcagcaaaaaggttaataaccttttttatagtcgaccagatgaatgtccggcttgctgccagcgaggtaccgttttaaatttggaatgaagatatcccggacaacccgctcgtcataatgttcggttgagccggccgtgtgcggggtaatgatcacattttccagctcccaaagcgggctgtcttcagggagcggttccttttcaaatacatccagcccggcaccggcaatttcgccggaggaaagcgcatccgccagttctttttcatttgcgatttcccctctgccgatattgataaaaaatgcagacggcttcatccgggcaaatgcttctttcccgaataaatgatacgtttctttcgtaagcggcaggcagacggcaacataatcacaaagcggcagcatatcatgaagctgaccgttcgtatacatttcatctacaaactcggcaggcgcaccggaacgccgcacgcccagcactttcatcccgaaggctttggcaatttttgccgtttcaagcccgatttccccgacaccgataatgccaatcgtctttccatgcatttccagctttaacccggcatggtcccatttctttttcgtttgatttctgacatatgtatggattttccttgtcaatgccagcatcattgcaaaaatggtttccgaaatcggataggcgtgcacgccgcttgcagaagtgagaaagagcccttttttctcaaattgttcgagtgggaaactgttcacccccgcactccagctttgaacccagcggagagcggaatcttccgataatgcatctttttccatttttttccgaaagctcgcaatcacttccgctttcttcacttcattctgccaatgcgccggatcctttccggccagtatgcgccactccgggaccagtttcctgatttcatcaagcaggccgggggcaagattttccgcaataatcatagttctttccgccatcaaactccctcctttatttcattaaatcatatattcgatataccgcaaaaatttcctgcttattctggtaatttctgtcatattcttttcacatttgcaaaaaccgctatcccttcagcctgtaagccttatcaatcatttgcatatatttttccgggtataaagccctatgaaaaagagactaaaaggtacgataaaagaaatagtgataaccgctatgaaaatgaacaaaaggagttgccctgtcatgcgaaagatggtagagaaacatgtacggtggaacatgaaagcgaaattgatggtttcgatcctcgcaatcctgctcgttccatctgtactgatcggatatttttcaatcaaatcagcaggaagtgaagtccaatcgcaaatgctgaatgccgccacggaaaatgtcaatctgttgcagaatatcatccatgatgcgatccagccgcgcatggacgatgtggattatttttctaaaaaaatttcggccgaaacggaaaaaaagccgtccgaaatcaagacgatgttcagccaatatgcaaatctgcataacaatgtcttgaatgtttacgttgggacagcttccgggaaaatgatgatcgaaccgaatggcaacttgcctgcaggttatgatccaaggcaaaggccgtggtataaggaagcgatggaacagcccggaaaagcggttgtgacggccccgtaccaggacgcgaccacgggggaaacgattgtcaccattgccaaaacgacgcaagacagctccggggtggtcgcagttgacctgaaaataagtacgattcaaaaaatggcaaaagaaatcaaaatcgggaaaagcgggtatgccgtgcttatagacccggcccgccattatatcgttatgccgggaaaaaaaccgggcgcgtatgcaaaagaaaaagtgtatgataccgtatttaaccatgtttccggacacacttcctatacgtatcaggggaaggaaaaagtgatgatttatacaactgatagcctaacgggttggaaaatcgcaggcaccgtgtacgctgatgaggtcggtaaagctgtacagccgatcatcgaccggatgatccttgtcatcgtcatttttctcgttctcggtacggtattagcctattttgtcatccgttctgtgacacggccgattaaccgcctgaaagaagcagcgttaaaaatttcctccggggacttaacagaggaaatagatatccggaaaaaagatgaagtcggtgaactggctgtaagttttaaaaaaatgcaggacagcctgcgcgatcttctcgaccaggttgataaaagcgcggagatggtcgtttcctcttcagaagagctgaaggcaaacgcggaaaatacaacacaagcaagccatgaaatcaactccgctgctgcccagattgcaagcggtgcagaaacacagacgaacggcacggaaaacagcgcccaggcgatgagtgaaattgcaaaagcaatggaaaaagtaaccgacagcacgatggcgatttccagcttgtccaatgccacgctcgaacatgcgaaacaaggcggcgaggctgtccgtgagacggtcgcgcaaatgaagtccattgccggttctgtcgcgcaatccaacgcaaaaatccaggcactctttgaaaattcgaagcaaatcagccagattacagaagtgataaaaggcattgcggctcagacgaatttgcttgctttaaatgcagcgattgaagcggcaagagcgggcgagcacggaaaagggtttgcggtcgtggcagacgaaatccggaaactggccgaccagtcgcaaaactcaacaaaagaaattgaaaagctgattacgcaaatccagcatgatacggaagattccgtccgcgagatggaacaagtgtccaaagatgtggaaaccggcgtgtcacgttccaaagattcgatcggaaaatttgacacgatcatgaacgggatgaaagagatcacaccgcaagtggaagaaatggcggcgatctcggaagaaatttccgcctccgtccaggaagtgacctcgactgcgaacgaacttgcccaaattgctgaagaaaatgcggcggcaaccgaagaaatggccgcttccattgaaagccaccttaagtcgatggatgacatcagcgattcggcaagagcattgtcctatctgtcggaatacttacaggagattgtgaagaaatataagttttaaagaagaagcgcccaaagcagaaatcccggctttgggtgcttttttggttggcgccttttataggtttagccaaaaatgggaatagagatccaaaaatttttgggagtgaattttgctcctccccacgacacaccgtgacggttggcacgcgagaaaccgatggagcagcggccactttgcaaaagggctttaggacgccggcaaaaagttttcggtgacaatggctccggcgtccattaaaataaaactaggaagatgatgaacaaattttttgaaaaaggaaattcccttatggaggagagaaaagcatgcatacatatgtcaattggcctgatgtggtatttcagttgggctggctcatttttctctgtgccgccggatttgctatttataaaatcataaaaatcaggaaaatgaagaatcagcatttgaaaaaatagtcaggaacggctctgagcctctccggagaaagggttacattacgggcaaaaaacgggaggaaatgggatggaactcacaaaggaacaatttaaggccgatttcgaaagaatgctgtcggactacttcacaatggatgtggaaaaatctgatttgacagagcagtatgttacactcggaaaattgatcggttcttatgcagcaaaagaatggcggaacacgaatcagcgctacttggaaaaaggggaaaaacaagtttactatttttcaatggaatttttgcttggcaggatgttgaaaagtaatttgttcaacctcggaattctcgatacggtccgggcggggcttaaagaaatggggatggacctggaagcgttggaacaggtggaactggatgccggactgggaaacggcggtcttggccggctggcagcttgtttcatcgattcaatggcgacacatgcgatccccgggcacgggaacggcatccgttttaagtacgggcttttcaggcaaaaatttgtcaacggctaccaggttgaactgcctgaaaactggctgcgaaacggcaatgtgtgggagacacgccggctgaacaaggcggtaaatgtgcggttttacggcaacgtccggcttgagaaagatgcatcggggcattttgttccccattatgaaaatgaggaaattgtacttgccgtgccgtatgataccccggtaatcggttacggggacaatacggtcaacactttaagattatggtcggcggaaatgccgcttgaggatgcgaacacggagtaccatgcttttattcagcagcaaagccggatcgaaagcatttcggaagtgctgtatcctgacgattccaattatgaagggcgtctgttacgtttgaaacaggaatattttttcgtctcagcaggcattcaaagcattatccgcacctataaaaaacgcggcctgccgatgtccaatctcgccgaaaaagtcgccatccacatcaatgatacacacccggcattatgtgtccctgaactaatgcgtattttgatggacgaggaaggcatggactgggaaccggcctgggatgttacggtaaaagtgctcagctataccaaccataccattatgtccgaagcgctcgaaagttggccgacagatatgatggcacagcttttgccgcgcatttatcaaattatttgcgagattgaccgccgctatgccgaggacatggcccgtttatatgactgggatatgattgagcggacgagggtaatttcgggcgggagcgtgaagatggcgcacctggcaatcattggcagccatagcatcaacggggtggcaaagctccatacgaatattttgaaagaaaaagtgcttcgtgacttctatcacattttcccgtccagatttaataataaaacaaacggcattactcaccggcgctggctgctgctttccaacgaaccgctgcgcagttttattgacagcaaaatcggcaaggagtgggcgacaaagccgacagacctgaaaatgctggagccttttcgccgggatgaaaacgtcctgcggcaacttgcggaaatcaaacaaatcaataagcaacggctggcagactatattaggaaaaggacagggctcgccgtctggacagatgccatttttgatgtgcaggtcaaacgtttccatgcttataaaaggcagcttttgaatcttttgcatattttaagcttgtattttaaattgaaggatgatccgggagcagatatttacccgcgcgttttcatctttggcggcaaagcggcaccgagctacacttacgccaaggaaatcattaagttgataaacgccgcagcggatctcattaaccatgacccggcagtcagggatatgctgaagatcgtttttatcgaaaattacggtgtgtcgctggccgagcggatcatcccggcggcagacgtcagcgaacagatttcactcgcatccaaggaagcctccggaacgagcaatatgaaatttatgctcaatggcgcggttacattggccacgctggacggtgcaaatgtggaaatccgcgacctcgtgggggaagacaatattattctcttcgggctgaccgatcaggaagttttccaatattaccatgaccggtcttatcattcctatgattattataagaaaaatccggtgctgcaccgtgtactcgatgcgctgattgacggctcgattcccggtgtgcaggcggaagggcgggacatctttgattccctcattaaatatggtgatgagttttttgttttaagagatttcgaggattacgcgctggcgcagaaaaaagtggacatgctgtaccgcgatccgctcaaatggcaggagatggcattgatcaatatcgccaatgccggtgtattttcatcggattataccgtgctcaggtatgcagctgaaatttggaacgtaaatagcaaaacaagacttttttagtggactgtctcccatcgctgtaaggtacgcgggctcagcccggtgaagcgtacccgcttggcgaatagaaaaagacggcttgctgtatattgtccggaattcccccgctaaaagcggccggcaaggacctggctgctcacttatgggggaaccgggcattcagcagcataagccgttttccgaacgggagaaaaaagggggtgaaatttcgtctgaatctttgcttttttgcagggaaatatgctggcttggcgaatatcattcaatagatttccggcaggagggggagacgcgtgaaaaacatttatttttttaccggttttcctggttttatcgcttcgtcgctgatcaggcggatggcacaattggattatccggccgggcacatttatttgcttgtgcttccggcgatgcgtcaaaaagcagaagcggagatcgggggaatttgcaagaaagcggaaaatatttcgaaggaacagttcaccgtcattgaaggggatattacaaaagaagggctctcgattgaggaagggatgcgcttcaagctggcagaagaagtaacccatgtgttccaccttgccgccatttacgatcttgcggtgaaacgggacatcgcctggcgggtgaatgtaacgggaacagagaacgtaaaccagtgggtaaaaacgcttaaagccttaaaacggtatgtgtatttcagcaccgcctacgtgtcggggaaaagggaggggcgcatttacgaacatgaactcgacatggggcagacgtttaaaaaccattatgaggagtcaaaatttgaagcggaaaagcgcgttcgcgacatcatgggggaggtgccggttacggtgatccgccctgggattgtaaaagggcattcaaagactggtgaaaccattaaatttgacggcatttattttcttttgaatacgcttacaaaatttaaaatttttcccgtgattccgtatttcggcgagggcacggcggaaggaaattttgtcccggtcgattacatttttgatgccaccctttatcttgcccatgcacatgccgagacgggaaaaacgtatcaccttaccgacccgcattcgtaccgcatgcgcgaattgtacaaaatggtcatggaagcgtatctcggaagaaaaccgcacgggaccatcccgctatcggtaatggaatggctgttttctattaaggctttccggaaatggctgaatgcggagcgggaagcccttgaatattttacatgcaaggcagaatatgactgtagcacggcccaaaaagatttggaggggtccgggatttcctgcccggatttcaaagagacattgccggcaatggtccgtttttatgaggcgcacaaagatgaccgcgataagcagctgaagattgtttaaagagaggattccgtatgaatgcagagtcgattctggcaaaacagcaagctttcttttattcggagaaaacaaagccgtatgcattccgcattagggcgcttgaggcgctgaaaaaagctgttatccggcatgaaagggcactgtcgggtgcgctccggaaagacttgaacaagtcggcgtttgatgcgtatgcaacagaaatcggcattcttctgagcgagctttcatttacattgaaacatttgaaaagatggatgaaaccggagcgggcaaaaacgccgctcacccatgccggttcaaaaagcatgattataccggaaccgtacggcacggcgctcattatttcgccatggaactttccgctgcagctcgcgcttgtaccacttgttggcgcagtggccgccggaaactgtgcagtgatcaagccgtcggaatacacgccgcatacttcaaaagctttgaaaaaactggtggaagaaatattcccggaagattttatcgccgtgatcgaaggcggggtagaaacgagccaggcgcttcttgaactgccatttgagccgttcggcggcgtcggggcaagcgggatgggcgcttaccacggaaaggaaagctttaatgccttctcccaccggaaaagtgtgttacgacaaacaaccgtcttcgacatcccgttccgttatccaaatatgaaaaatgggttgacaaaaataaaaagatttttaaaatgaagattgacattttttattttcagcattaagataataatcaatcaatggcaatgaagaagcgtaacctttgtggattccgaagagagccggtgggtggtgcgaaccggtgatgacatgcaggcgaatgggcttccgagcttccaaaccgaaacgtccggagtaggctttggcgaatgccttatcgttacaaaaggcaggtatacggtttttccctgataccgtcaaagccgggctgatcaagccaataaaggtggcaccgcgggtttcccgtcctttacgtggattggggtcctctttatatttttttaaaaaatgggagagggattatgatgcaactgaataagaggcactttaactgatataaaatacgcgcttcatgaattaattgaaggttttttttatggagaaatgaaagatatggctcacaaatatgcgagtgagcatgagaaaacaaatcttccttttggaatgttgtgtgtaaaccaccaccatttgctgggcggaaaaagcgcttctgtttttcatgtggcagcatgtgtagaactgattatacttgcctttaatattttagatgactggcaagatcaggatcatcatcgctcgccatggatgcaagatcatgcaggccaatcattgacggtggaaacggcctttttgttgttggctatgtcaaaattgaatggatttttaggcagtcaaaaaaataatttggcttttcaactaatcgttgaccgaataaatcgttccgttcatggtcaatttgctgatattcgaaatgcaccattgaaagaagaagaatatattgcagtaattaagcaaaaatcaggagcactttgtgcgctcgcttgcttgtgcggagctatgctagctggtaatactactgatcttcatttaataggtgagtatgcaactggaataggtatttgtgcccagctcgagaacgatcttgatgatgttctccatttgggtgaaaaaaatgatctaattcacaaaaaatggacactggctaccatgtatctcgcccatcacccaagccgaatcggaaaggcagtggcatcttattttgaaaatcggctgtctttagatcgattactagccattcaatcattggaggcatggattcaatcatcaggtgttattctctatacaagagttttaatagaagctgaaaaaataaaagcaaaaaacattattgataaattgtccgttgacgaaaccattaaacgacaaatcaagagctttgttgatggaattcatttcaaggcggatatcccaggagaaacttaagattgtaaatcttagttttttccttaatctttagttggaaacatcattttaaaatatataaatggtattatatggatgatagatgaataatatgggagatgataagatggaaacgtttatttaccagttgatgaagcaaccacatctgattgaagaaattaaagcggggacttttgattacccggaatcttttactgaagaagataaatgtgccgtattgaatgctatcaaaggggagaacagtcaagattatcgtttatgggcctgatataaaatgattagaatgcgctttcttttgctaactggtttatttttgtcgtttatacttgctacgtattttgtgtttgttatttttaagtatccatacataggcattattgtcaaaaaggcggatcatcaaatcgtggtggacagtgtagatccgtacgggtgggcttctgaacagtccatttacaggggggatgttatccggcttattgacggacgttctccaacaaaaaagccatccgtccaacataaggagattattagtgacgctaagaaaataacgatagaacgcgggaaccaggatgtacaatataaaatagataatcatcagcctgttactggaatgatttattattttcttgttccatcggttttctttttggtttgtttttctttaggatgttttttatttaaatttctggataaaaacaagtcaattccagtcctgatcctttttttagcagtaatcgcccccgtattactaaatattagtgccaattcccgaatctacaattggagcaggtatacagtggggatatttatgtgtatcagtctggtattgctgctacattttttgcgaaattattatcattcctcatcacgactggtttcaaaccatgtgctttcttttctatatttaggcgccggacttgttttgataaaccgggtaatcgccgccgattatccgcttgaactgttttttgtgcccgttgtctttatcattcttatgatctctgtttttcgattatattatcaaacgaaaaacagtgaggtgaaaaaatcattacaggtgctttttacgggtatcttccttgcccttatgccatttgtcacactttacgcacttccaatcgtcattttcaaggattcaatcatgccatgggagtggacaacaccttttcttgtttttttaccaattacaacgggctatttggtgctgacttataaaatgattgatttgtcctttattatcaaccggctgcactattattgcttgatgagcctaatgataatgtccgttattttaacgggaacgctcgcttttgatccgggtaaactgtcgggcaatatatttaggattacacgcctggctctgttcgtttttactgttatactgttgtttttatatataaaagattatgtcgaataccggtttagaaaaattatgtttccaaaacggcaggattttcaaatgagcttgaatcgttttttgcaatggatgaagtcggagcataagctggctaatttagcctttattttgaaacgggaaattgaaaactttctgccagctaaggaagttactttagtaaaggtcgatcagaatgggaaagctatttctttactcgacaatactaaagtgaatgtgacacatcactcgatgacgaatgaatgtacagaacgtcttcagatggatgtgcacgggtttaaaatcaacttgtatcatgacaaaagcggcacgatctttttatatgggcgttggaaaatgcgaagaaagctcaatcccgatgaaaagatttggcttgagacgcttttaaactatgcacaggttgtgattgagaatcaggacaaggctgaagaccttatcgctttattaagcttggaaaaagaccgggatttgttgccgcatacagtaaaaaaagcaatttttaacatttcagagcgcgaacgcaagcaattgtcgagggatctacacgacacgatcatacaagagctgctggcactggcgagggatgtcgatatcaaaagggccggttgtgctgatccatttgttattgacatgctgtccgaaattcgggagggaattttaaataacattaaaacattgcgggaaatcatacatcatttacatccggaatttattcacaaaatgggcttgccccttgctctgaatcaattatgccttcaagtacaaaaacaatcatcatttgctttacatatgcatatcgatcagcattttacaatttttgatcgtgaactggaaatcaacatgtatcgtattgtccaagagcttttaaacaacgcgatcaagcattcccaagcagagcatgtaagcttaattttggctgaagaaagcacgaggtatattcttctttacgatgatgatgggattgggatagacaaagatgtactcaaacgccagcatcatttcagcacgatgggatggccaggtttaaacgggcgcgtagccattaccggcggtcaattaaacatagactcacttaaaacaggaaacggtaggaaagggcttcatatagaaattgtctggccaatcaaccggggtttataaatagccagttttacaaggaggagtataatgatggcgtccatacttgtcattgatgatcatcgtttagtggcaagcggtacgaagagtttgctgcaaaacgctggatttgaagcggaagccattttttctgctgattatttaaaagaaaagatagagagtgcgaattatgatgtttttcttattgactggagttttcctgaagtgaacggtctggaaatatcaaaaaaaataatcaaattacagccgcaagctaaaattattatttatacgggttttgattcagaacttgctattgtgttggaccaattaattgaagaaggcatttccgggattatcagtaaaacggcctcagtgaatactttaattaacgctgttcatgccgttatcagtggatacagcatttttccaaatacccttgtgaaagagtctgtttacaccctccggttgaaaaaggaaactgaaaatctgtttagtgaaagagaaatagaaattattgagtgtttaattgacggtgatacgaacaaggaaattgctgctaaactttacatcactcaacgttctgtagagtatcagctgcgctccatttataaaaaattgggcattcattccagagaacaagtcgcggatagagtaaaagaaatgaggattatttcgcctgattcatataaaattcatggatagagcggatttgcaaagaattccgcttttttggtattagccaccaatgtttgggcagcagctgtccactttttttcggtgttaccacacaaaaatttcggtgataccccgcaaagatttcggtcatgccacacaaaaatttcggtgacaatggctcttttgtcaattaaaataaacgtgtcattttttaggcacttttttgacaattaaggatcccctcagtgcaaagtaaattaggtcatttgtactgtgtgttggtgatgtctttttttatatcaaatttgattggaggatgaaaagttgatcgaagccaaggacatctccgtttcaattggaggagtacccgtgctgcatgctgagtcagtacgttgcaattccggaaccatgacagctctcgttggtcccagtgggtgtgggaaaaccacacttctgcactgccttgggttgttgctcccggtggatcaaggccagattttatttaatggaaaagatgttacaaagtacaattcatcggcacgacgcaaattttggtgtgatcacgcagccttcatacttcaagattacggaatcatggatgaggagtcgattgctttcaatgtaaccatgcatgcaagtatgtttggtcggcgtttcaggggaaatcgcgaacgcttggcgaaggtacttgagcaaacaggtttacagggccgggaaaaggagctggccggtcacctaagcggaggagaaaaacagcgattagctttagcgcgtgctgtttacaaggatgcggagcttctatttgttgatgagcctactgcttctcttgacgcagtcaatcggaaaaaagtcttccatttgttggtaaaatttgctctgagtggtcgtacagtgattgtgtcaacgcacgattccgagatgattaacgcatgtggtgccaaatatgaagtcggttctaacagttcattacataatccgtcttctactgatttaactggtaatatgggagaaaccttatgaagccggttcataagaaaattattggtgtggttgtcggtttgttgctaatagtgggagcgcttgcgttactgaacggctggttctcaggctcagaggacacgcatccgccgtgcaatcagctgccgactgtgtcgaaggtagatgaggcgattgctagccatcaaaaacttactaaggagataaaatcaataggggatgacattacagttgaagtggggaggccttgctccaaagaccagaaccggggactggtcatggtgaaatatggtacaaaaactgagcgtaaagcgattgatgatcttctcagccgtcgaaacgggttcggggtcccggtatatctggtgaagaactaatgcctatttccaccgtaggatgactttttacattaggaaacagcatggcaataattcatttgtttttttaaatatgttggccgaataacagtgtgaaggaaggaaaggaataaatgaaaaaacatgatctgctaatcctcgctattacacagaggctcaacgataataataaaaaacattgggaaacggtgagtcgagtttctgacgttcatggagggtttatctgtgtataagcgtattatcgtggtggttgcgagtgccttgtttgcactacttgcgttgctcgctgcaattatcacaggcctatatgatcgagactttccacaagccattcatactgggagtaggattagcctagactttagcgaatcaaatatttccattactaaggcatttgacacgttggagaaattagatccacgctggggtctgggactaggtgaactcgttaaagcaatcaggtgttaaggtgagtcgaacggatgcgtcaatttttcgcagtctagaatttgtggtgcgggaaaggggatttgctgctgctgttgttgcagcttttgcgctaatcgccgcactggcgttgttttggttgtcgttgagagcacgcgggcgagcgctccgtgttttaggtggatgtccaaccgtacaaatccaaatgcaggatctatcagggttcggtggtgcactactgcttgcggcgttagtcgtggtggtggtttcagcaggctatgtaggtatatttcatggctggatgtacgtaggtgcctttctcaaagctttagtaagtctacaagttgcaatcatcggtgtatccctattcgtagcgtttgttatgtcggcttctgcctggccgagcgccaccatgcttgccaccagacaaccagcagtaaagagcctgcgtgtagcggcaattgtgattcaagtattaacttttctactggtggttgctgcggccggacccgcatggtctacatacaaacactcttcagctatggcagctgaaatggcacagttgaagcaattggcagaccaagtcgccattgtatttgcaacagatgttgatgaaatggacagcttggaaccccaaattggcaaattagtaaaagaagctgaatcgcgtgataaggttgctctatcttatacttttaccaaagaaatgggattaccggctgattctggaaagtattcagcagtctcattcgtgaaccagcgttggctcgacctagtgactaagggtgcaccacagtcagctgttaaaccggtaccttatcgcagtattccaaagggactcattcaaatggttcgtgaagagactaaacttctatcaaggcatggtttttctagggaatcattcggacagcttcagtttatgcaaccagtaaaagggtttcagttaccagtggcccaaggaggtgggggccaaagtcttcactttgctgacgatgtcctggtcgttgttgtgccatcgatttatgatgcatttaacgattctacactaacctccatggcttcaactagtaacattgtgtttaccggtgtggctgctacacagcaattgttaaaaaatcacggccttgatgtgcgcgcgttacgcgaacacggcattcatggtgaacttcatattgcttacattgctgaagatgggattcttcaagcgcagtttgcagcgaatgttgtaaggttgcagagctttgcgctgattgccttggtggttgctttcactgtcgcaacagtgatcagtgcgttgattaccgcgatattacgggcgaaacatgacttcccgcttcggttggcgggtcaatcttgggcacggattttatggaatcgtgtggtcaaggaattgctaattggtaccggccttgcgggcattgttgtcatgctacaaaggccagatgcgatggaagccgtacttgtgatagcagtatatggattgcttgtcgtaccgttaagtcatctttttgctacgcgctattgtttcaatggtgttatcagacgtcgaatttgatggcagtctcagacaattttatatgaaaaatgtttaaatggtcattttatttaatgtgcaatctgaactgttttctgttatataaacgaagttggtttccaacttttcattctatgaaatattttttggattgagatttttgtgggacttctttctttttagggaaatccctggattattctttttactactattgtttctagggtaataaccattgtagaacataaggaataataaaagacatttgaaattaaaacaaaaataaggtacatgcctgaggccagcagatagagtaaaaaaatgaggattatttcgctgattcatataaaaatccatggatagagcggattcgcacagaattccgcttttttgtattagccatcaatgtttgggtagcatctgtccactttttttcggtgataccacacaaatttttcggtaataccacacaaagatttcggtgacaatggctctagggcctattaaaatatgagtatcagatacgttgattagtgtatctttctaaagttcttaatgtccttaataactgataaaaaatacccttgattttcttatgagttgaggaaaaaagattgaagaattcaattattaacaatattaaacaattaatggagagataaacaaatgaaaaaaggaataacatcatcaaatacttattggatttttatttctttattttttatagtaatatttaatgctttttttcaatactgtattcatcaaaaagcgctaaatttgttttggtctcaggttgataaagaaaatcatcttggctcttcaattaatgtaatattttatgttgttcaaagttttacggtgcttacgtcaatagttggcatattaataggagctttagtggttgctttttttggattcctgtttggaattaaaaaaaagaaaaaagattatttgttagtttattccctaacttcattatttctttcatttaaacttgtcatagcaggcatagtaaatctgtttcatgcaaatgcaagcaaaatctatattgttggaaagcagagtttccttacgcaaatagcggatccttttttatggttaagtactgttttatttttccttttaggagttaatattttatcaagcaacagaaaaaaagtattttatttaacactcatttatttgctgattaaatttgtgaatatcggtctctcttattttttaaattatatagtttaataatgggggggctattaaactatatatataaaaattaagattggagtgaaatgtatggtaaatagcttaactaacaaaaaaagggtatttctgtttgtggtaattgggctggtactcgccactctgtcatcggttgcgtatatcagcacactacaaatcactattcatcaaactgcagttttgcctggcaatgcttacttagcaagcacccttggcatttccaccgccgcagcaaagaaggctatcgatattatcgatactgcttcaacgattgcatcaattatttctttaattggtgttgtaacaggcgctggagctatctcttacgctgttgtcgctactgctaaagcgatgatcaaaaaatacggtaaaaagtacgcggctgcttggtaattagcattacctgccccccttttttagtttgaagaaagtattaaaacaaagcaagatgcaggtgttgtttccaaaatgcgcgtaatcagcgtgcgccggctcccggctttgcccgaagaaacgggagatgcaaccgctgtgaaagaggatattttcgcaaaatatcaaaccgaggcagagcgcctgcttttagacagtcaaaaagaagcagaagcagtacgccggcaaattgccgaagagaaaaaacagtgggagcaggaaaaagcaaagctcaccgaacaagcacagcgccaagggtttgaagccggttatgcagatggccgcaaggaagggtttgaaagcatccgcgaccatttaaacgagtccattgacatcgtcaaccgttccaaagaggcgttcaaaaaacatttagaagcatcggaaaaagatattttggaaattgcgatgaaagcagcggggaaaattttgcaagacacacttgaaacatcccccgaaaaaatgtttgccatcgtaaaaaacgtattaaaagaagcgactgggtataaagaagtcgatctccatatccatccggggcagtacgccttcgtcatggacaacaaggaagaactggatgccctcttcccgaacgatacaaaatgctatgtctacccggatgattcgcttgaaccgtaccaggtctatattgaaagcggcagcggcaggattgatgcaagcattgacagccagctgtctgaacttaaggcaaagcttttggaactgatcggggaggatgcggaatgaaagcaaccgatctcttagactatatacccgaaattgggacgtttaaacattacggaaaagtaaaaagagtgatcggcttaatgatcgaatcactcgggccggaaagctccatcggtgacgtctgttatattcatgtggataacaaaaaaaatacgaaaaaaatcattgccgaagttgtcgggttccgtgacgggaatgttattttaatgccttatacgaacatccaagaaatttctcccggcagccttgtggaagcaacagggaaaccgatgcgggtgaaagcaggcccacggctgttggggaaagtcattgatcctttgggcgtgccgctcgaccattccccgcttcccgccggcctaaaaccgattccgatcgaccggacgccccccaacccgctcaagcgcccgccgatcagggaaccgattgagcttggcgtccgcgcgatcgacagtctgctgacggttggaaaaggccagcggatcggcatatttgctggaagcggcgtcggcaaaagcaccctgctcggcatgattgcacgcaacacaaatgccgatctgaatgtgatcgccctaatcggggagcggggcagggaagtaagggaatttattgaacaagatctcggccctgaaggtttaaaaaagtccattgttgtcgtggcaacaagcgaccagccggcattgatgcggattaaaggcgcctatacagcaacagcgatagcggaatatttcagggaccaggggctaaatgtcatgtttatgatggactcggttacccgggtcgcgatggcccagcgtgaagtcggactggcaacgggggaaccgccggctacaaaaggatataccccgtccgttttcgcgattttgccgaaacttttggaaaggaccggaacaaatgagtccggcacgattaccgggatctacaccgtgcttgtcgacggggatgatttgaatgaaccgattgccgatacggtgcgcggcattttagacgggcattttgttctggacagggatttggcaaataaagggcaatacccggctatcaatattttaaaaagcgttagccgactgatgagccaacttgccagtcctgcacacaaaaaagccgcagaaaagattcgcgaacagttaagcacttatttgaattcagaggacctgatcaatatcggcgcttataaaccgggcgcatcaaaagaaattgatgaagcgatcgaacgctatccgaaaatcgtttcttttatcaaacaaagcaccgacgaaacctatagtatggaaagcagtatccgggctttaatcggacttgcggaaacgggtgagtgggcatgaattatcattataaattcgagaaaatccttgatgtcaaagaaaaggaaaaagacgaggcgctcagtgcatacaaaaatgcggtacaggcatttgaaaatgtggcccgggagctgtacgcgcttttgaaaaagaaagaagacctggaagcccaccaggctgaaaaaatgaaagcgggcctttccgtccaggaaatccggcattaccggcggtttattgatgatattgaaaaatcaatccattattatcagagcctcgtcatgaatgcacgaaaccggatgaactggcatcagcagaaactgcaggagaaaaatatagaagtcaaaaaatacgaaaaactgaaagacaaagattatggccgttttctgatgaaactgaaaatacaggaagaaaagcaggcagatgaaatttcaacccagactttttatcactaaagcctgaaaaccgggtgatgttatgcgcaaacaaatggaagaaatcgagacagcagcagaagaaaaaaaaggcggtaaactgcagtggtttttttacgtgatcctgattccgctactgtttgccaccgcgatggcgatcattatcgctactatctcgggtgtcaatgtgatcagtaaagcatcgggcctcgcccatcaggtgaccgggatatttggcacaggcgggaatgaaaaagggaagaagcaaagcggcacgttcagtgaaacacagtataaaagccagatccgttctttacaaaaacaggcgtcagaaaaagacaaagaaatcagcaagctgcaatccgaactggacaaaagccaacagaacaatttgaaaatgaaacaaaccgtctctgatctgaagcagcaattgaagaaagcccagcaacaacaggcagccaatcagaaaaaattaaaagaaatcgcaagcacctatgaaaatatgaatccggaaaatgcggctgccattattcaaaaaatgagcgatcaggaagcaacggggatcctttcccagctcagttcggaaacattggcgaacgtccttgaaaaaatgagtgccgataaagcagcaaaatacacccaaatgctcgggcgtacaggatcataagccatccattaaacttgaaaggaggtgaaaacatgaatgtaaattcggctcttcaggctgtaccattttctccgccaagtacgcaaacggctggcgcacagctgcagacgcagccatccgggttttttcagcaattgagccttgccggccaggacagcggccggatgccggaaaacgaggaggcagtggatgtttgccaaaagcttcaacaaaggattgtcgcggttttaacggaaaaggccggggcaacggaacaggctagagaagatggaagccaggaagaaggggctgatatgcagaccatttccgctcttttcaaccggctggtgcggtttgccggcgctgaagacgaaaacagcaaaaaaaagatacaagaaacaaaaacggccatcgaaacaggcgatgccgcagctgccatcatgaatatggcgcaaatgctcgcctccatgccagtcccgtctttaataaagctcggacttgaagatgcggaaacattgctcaggcaggtgggggctgttctaaaaacgtttcccgaaaatacagcagcaggcatcaacatgatgcagacaacggaacaattagcccagttgtccgaaaaaatcggccgttttctcaaggccatttcagcagatgcgctaaacgcggggcagacggtttcaagcgcgccgcaacagccgggcattgccgtaaaagaagaaatattaaaaactgcttatttgcatttatccggcggaaaggcggatccatcgctgtttaaaaaagcacctgttcttcctttatctccagctgccgcggctctaggaatggcttccaatccggatcatgccaactcggcgcaaaatggacgggaaagtaaccaggtattgcttcaaaacggcccagtttctgcaaatggggcgattccggaaatgaacgaagcggtattgccggcaaatgaaagaagcgaaccggctgctgcaggcacgggcaccaccggaacagcactgctacaaacagacaacaatgaagtgacggaagccttatcaaaggatggccgctcatcccggcaggaaggggtgccgtttagtctggcagcagaatccgtcgccgcggatgaaaatgctgggaatccggctgcaaaaccgctgcaggcgggtacttcaggagcggacgcgcaaaatggcaaagcagcgattcggggcaatgcgccaagtgaaagcaggacaggcgggccattgcaaaatcaggcgcccagtgtgcaaacgaccgcccatccagaggcaaataccgggcagcctgcagatggcagccagctcaaggcactaaaagcaacggctgatgaggtgcaggccactgcaagccagcatattgagctcatggaagacgggataccgggaagcaacggcagggtgaagacgcaggcaacagctggtgaaaatggccggattgctgtgccaggccaaaatgcgggtccccagcaggaaaacggaaaactagaagacagcagccggcatgccgcattggatttttcccgggaaatccagcagacaggacaatccggaaacgatagcaccgaagatggattggcaaacggatgggaaaccggaaaaagaagccctgttgcgcataacagcagccatcttcaagcagcagaagaaataaacgggaacggcaatacagccccggcattttcactctcgggcaaagtggaacagctcgtcctttacaccggcgaaaaacataatccggtttcgtaccggcagtttgtccaggaattcgccaatatcattcaaaaggcggcctattccagccataaaggcgcaaacaggctgttgatccggcttgaacctgaaaacctcggttctttgcgcgtggaattgcttgagcaggacggaaaactggcagcaaagatactgacagacactggtgcggcaaaagatttgcttgattcccagctgcagcagcttaaacatgctttggcaggccagcaggtccagttaacaaaaatggatattgaataccgtgacacagcggcacaaaccgcccacggccagcccggggacagcgggggccgcgaacaacggcaacagcagcaaaagcggcgggaaaacccggaagcgggacatttttcagccatgttggaaaacaatatgattgatgcggaagcgtaggtgaatgacatgacttctattgacccgagcctgctgttgagcaatcaaaatacagcttccggcacgcgtacgggaagcaagacgctggataaaaatgcttttttgaaaatattgattgcccagcttcaaaaccaggacccgaccaacccgattgacgacacgcaatttgtatcgcaaatggcgcagttctcctcattggagcaaatgacgaatttgaaagacgatatcgacaacctgatcaaactttcgcagcaatcgcagcaaattgcgtatacacaatatatcgggagaacggtttcctggaaaaaaaccgaaacagctgatgacgggacggcatccgttaagtcgggaaccgggacgattaccggcatttcattcggtgatgacaatgcggccaccttcaccctggatgacgggacgaaaatcagtttttccgatatgacagggatagacagcagcacttcaaatgaagcagcactgattcaggcaagctatttaattgggaaaaaagtgacctatacaaatgatgcaggagaagaagaaacagcttcggtcagtaccgttgccatccaaaacggcagcctggtttttacacttgacaacgggaaaaaagccgcaagcgggcagcttacgaaaattgcaaactaggaagtgattgaatggatcaatcctatccgtccattccattgcagcgaaccgcgcctatgcgttctcttaatggaacgcagaaatccggccaaggaaaaaaccaaaccggccatttttcggattatttgcagcaggcattgtccgggcagtctgaaccagccgcattaaaaatcagcaaacatgccggcgaaaggctgcaggaacgggggattgaactggacgattccacctggaaacagatcagcacaaaggtggcggaggcaaagaaaaaagggctggatgagacactggtcctggcagatgatgccgcgctgatcgtcagcgcaaaaaatgcaacagtgattactgcaatggaccggagtgaagccggttcccaaattttcagcaatattaacggcgccatcattttagaatcaccggccggaccggaaggaaggccgcagctgccgaatgacagacgcagctgaaaacaaaaatggagaggggttaatgcaatgttacgttcattatattcaggtgtaagcggcatgaaaaactttcaaacagaacttgataccatcggaaacaacatcgcaaatgtgaatacttacgggtacaaaaaagggcgtgtgacatttaaagatgcaatcagccagacgctggccagcgctacgcccggcacaagcgcccagcaggttggccttgggtcccaaatcggttcaattgataccgttgatacttcaggaagcccggaatcaacggggcgtccccttgactttgcgattacaggggacggatacttcagggtacaggatggaaatgacacgtattatacgcgtgccggcaatttttactttgatgataacagaaggctcgttaattcagaaggttttgctgtgctgggcacaaatggacaagcaatcacccttggagcaaatgtaaaaagcttttcagtcgcaacggatggaaccatttccgatcagaatggcaatacaatcgggacaatcagcattgccactttccagaatcctgccgggttgacaaaagccggcggcaatttatacaccactgcgaattccaatgcgggccaggtgacagtaagccagccgggacagaacggtgcaggcacgatcaaatccggctatcttgaaatgtccaatgtcgacctgtcggaagagttgacgaatatgatcgtagcagaacgcgggtttcaggcgaatacaagaattatcacgacatccgatgaaattctgcaggaacttgtcaatctgaaacgatagggggaagggggccagggcttttcgcccggcccgcacaatgtgattgaagtgacaaaattaaacggcagggcattctggattaacgccattcatattgaaacggtggaaagcatgccggatacaagaatcatcctgacaaacggccacgcctatattgtcagggagtcgagcaaagaaatcgagcaaaaagtgaccgcctttttccgggctgtttctttgcttggaagaaatgccggggaggaggggccggaatgaataaaatggtgcggatcatgcttgtgatgatttccgtcattttactggccggcatcatcaccattgtcgtcatttataagtcgaacgaagcaacaaacgcaacagggccaaatatagatgaagttgtcgactcttccgttgacattgacacgatgacaaccaatctgaaagacaaccacattgtccagattgccatcaaaattgaaggaaacgataagaaagcaaaagaagaactgacaaaaagagatttccaaatcaaagacatcatgattgacgagctgtcaaatatgaacatgcaggatttgcaatctgagcaggggaagcaaaagtttaaaacagacataaaaaaccggttaaataaaatgatgcaggacggcgaagttgtaaatgtatatattacttcctttgttatccaataaaagtatgccgcctgccggatcaagggcagattgcagcaaaaaggcagtgccgcagcaggcagtccggcccctgtgcctgtatgtatacaaagggggtggataaagttgccggaagatattttatcgcagtctgaaattgatgcgctgctatccgccctgtcaacgggggaaatgaatgcggaggaaataaaaaaagaggaaacccggaaagtcaaagtatatgatttcaagcgggcgctccggttttcaaaagaccagatcagaagcctgacaagaattcatgaaaacttctcaaggattctcacaacctttttatctgcccagctccggacttacgtgcagatttcggttgcatcggctgaccagattccgtatgaggaatttatccgttcgataccgaaaatgacccttctgacggtttatgaagttcccccgcttgacgggaatattattatggaaattaacccgaacattgcctacacgatgatggatcgagtgctgggagggtacggggaaagcatcaataaaattgacaaactcactgagattgaaaagaaaatcatgacgagaatttttgaccagaccatcgaccagttaaaggaagcgtggagtgagatcatcgagatcaatccctttctgactgaactggaagtcaatccgcagtttctgcagatgatttctccgaatgaaaccgtggtcgttatttctctcaacacgacaatcggcgatacaaacggcatgatcaatttatgcctgccgcaagtggtgcttgacccgatgatgccgaaattgtccgggcattattggatgcagcacgccggaaaggaaccggatccggacaatatccgcctgctcgaagaaggcatcaaggaggcaaaagtgccgctcaccgccgaactggggacggcaacggtaaaaattgaagactttctgaatttagaaattggcgactgtatacggctgaaccaaaccattgaagagccgttggttgtcaaggtggataaaattccgaaattcatcgggcagccaggcaagcaaggcactaaaatggctgtccaaatccttgatatcatagaggaaggggaagaagaacagtatgagcgatgatatgctgtcgcaagaagaaattgatgcccttcttaacggcactgcaaatctggaagacgcaagcgccaaagattccctccgtgtggaagattatctcgattccatggaaagggatgcgcttggggaaattggtaacatttcgttcgggagctctgcgacggcattgtccaccctgctttcacaaaaagttgaaattacaacgcctgaggtcagcattgtccggcacgacaaactggcggatgaatttccgcatccttacgtggccattcaggtgaaatacacggagggcttttccggcgtgaatgtgctcgtcattaaacaatccgatgccgccattattgccgacttgatgctgggcggaaccggcgaaaatccgagcagcgaactggatgagatccatttgagcgcggtacaggaagcgatgaatcagatgatgggttctgccgctacctcgatgtctacggtttttaataaaagaatcgatatttccccgccggccgtttcacttttaaatattttggaaggcgaaggcacggacaagcttccggaccaggatttgcttgtgaaagtctcgttccggattatgatcgggtcattaatcgattcgcagatcatgcagctgttgccgctttcgtttgcgaaaaaactggcgcgcgatctcattcatcctgaacaacccgccgaagctgaaaaaaaagcagaggaaaagcagccggatcaaaatatgcgcggccatgctgcggaaaaaccggctgagcctgctcaaaatgcagcaaaacaggagatgtaccaaaatgtgcagccagctgtttttacgagttttgaagaaacagcgccgcgcgttgaaacgaaaaatctggacatgctccttgatatcccgcttgaagtgactgttgaactgggcaggacatcgaaaacagtaagggaaattcttgagatgggcgccggctccattgtggaactggacaagctcgccggagaacccgtggatattctcatcaaccatcagttaattgccattggggaagtggtggtgattgatgagaacttcggtgtgcgtgtgacagatatcgtgagccagaaagaccggctgaaaaaactgagataatgggggaagatccaaatggcaaagaaaattttgattgtagatgacgctgcgtttatgcgcatgatgattaaagacattctgacaaaaaacggatatgacgttgtcgctgaagcgggagacggcgcacaagcaatcgaaaaatataaggaacaccggccggatcttgtgacaatggatattacaatgccggaagtggacgggatcagcgcgctgaaggaaattaaaaaaatcgacccggatgcaaaagtcatcatgtgttcggcaatgggccagcaggcgatggtcattgatgccatccaggccggtgcaaaagactttatcgtcaaaccgttccaagctgaccgtgtaattgaggccatccaaaaaacgctcggctgacgatgccaggaaggtgacaatgatttgcaaagccaagtgacgaaggggcttttgctgtttgggattctgctgtgcctgctgtacgggttttcggcacccggcaatgccctcgcggcttcttttaacggaaatgtgaaagaatgtatcgaccatccgaaacagtgtcaaaaacaaacggacggaaaatccgaaagccaggctacacaatcggaaacggcaaatccggcggtaaccttcggggatattgcgcggatgatcctcgcacttattttcgtgatttgtttactatactttgttttaaaatttgtcaacaaaagaagccgtgcctatcaaagcagtaaaatgatacagaatttcggcggcacgcctttgggcggaaataagtcgctgcaaattgtaaaagcgggcgacaggattcttattttaggtgtcggggacgatgtgcagcttgtcaaagaaattgatgacgaggaagaggtcaggcagttcgttgaccagtacaatcaaaagctcgaggagcaactggaaccgcgcgatattgcgacaaggctcataaaagcggtgaaaaacagggaaactggggcaaaaacagaagcaaccccgttcgggcatttgctgaagtcgcaaattagcgcgatcagggaggagcgggcgcaggcgatgaaagaactggaacaaagggagaaggagaaacagaacgatgaatgagttgttgaatacattaagcagcacatccggcgataccgtttccctttcggtcaaaatccttttgcttatgaccgttctttcattggcaccgagcattttaatcctattgacttcttttacgcggattgtcattgtcctgtcttttgtccggacttcgctcggcacgcagacagccccaccgaatcaggtgatcgtaggccttgcgctgtttctgacgttttttatcatggctccgacgtttcaacaggtaaataaacaggcgctcacgccgttgttccatgataaactgacgctggaagaggcttatgacaaagcccagaagccgtttaaggaatttatggcgaaagagacccggcagaaagacttgcagctgtttttggattatgcccataaaaagcagcctaagtcggtgcaggatattccaatgacaacccttgttccggcatttacaatcagcgaattaaagacggcttttcaaatgggcttcatgattttcattccttttcttgtcatcgatatggtcgtggcaagtgtcctgatgtcgatgggaatgatgatgctgccgcctgtgatgatctcgctgccttttaaaatcttactgtttgtgctcgtggacggatggtatcttgttgtgaagtcgctgcttgaaagtttttaaagaaggtgaatggattgagtgaggaaatggtcatttcactggccgaaaaaggcatcatggtgacctttatggtctgcggtccgcttttattgattgcgcttgtcgtcggtatgattgtcagtatcttccaggctgcaacgcaaatccaggaacagacgctggcatttgtcccgaaaattgttgcggtgctgctcggccttgtactgcttggcccgtggatgctaagccacatgcttacatacacaaaagaaattttatccaatttaacacaatatataggttaacatatggatgaactgattccgtcattcagcatatttttactcgttttcattagggtcaccactttttttatcatgatgccgttattttcccacaggagcgtaccggcccggttccggatcggccttggcttctttttgtccgtccttgtgacatacacgatccatgccaaaccgttcaccatggatggcgcctattttatgctgatgattaaagaagcacttgtcggcctgctgcttggctttgtagcctatttcattttgtcggccgtgcaattggccggtacgtttatcgattttcaggcagggttttccatggccaatgtgattgatccgcaatcaggggcgcaaacgccgcttaccggggaatatttgtacagttttgcgctgcttttattgctttccctgaacgggcaccacctgcttttggacgggatttattacagctattcgtttatcccgctcgatcaggcatgggtccatctcgggtctttcaatctcgcaaaatatttggcaacccttttggcccgtgtgtttctcgtcgcttttcaaatgtcggcacctgttgtcgccgtcctgtttttaacggacattgcgcttggcatcatcgcccggaccgtaccgcagcttaatatttttgtggtcggctttccggtcaaaattgccgttagtttgatcgcgctggcggtggcaatgggcacgatttatatcgcggttgaacatttgtttgaatggatgtttgttgcgatgcggaattgtatggcactgttggggggatccgtttgaagcacctctcactcgatttgcagtttttcgcaggggagaaaacagaaaaggcaacgccgaaaaagcggcgtgatgcccgcaaaaaggggcagacagccaaaagccaggatatcgtaacggctgtcatgcttcttgcggtgtttctgttcttgtatttcggggcctcctcgatcggaagcccgatgatggcactctttcgccaggctttttcaaaatatatgctgcaggatgtcacggagcaaagcgttggcaaattgatgaccggcgtcatgaaacagctggcttcgatgcttttgccggttatggccgttgcccttttggccggcgtggtcggaaatgtggcccaaaccggcctcctttttaccggtgaagggctgaaaccgaatataaacaaaatcaatcccgtcgccggattaaaacggattttttcgatccgggcgcttgtggaattgttaaaatccgttttaaaaatggcggtggtcggcgttgttgctttttacgtcatttgggccaatatccaggatatttcaggcctgccgtttaaaagcgcgggcgatacgctggctgcagtcgggcatctcgccgccataaccggcatcagcgcttctgttgccctgtttgtgctcgccgttcttgattacttgtaccagcgtttcgattttgaaaaaaatatccggatgtccaagcaggaaatcaaggaagaatttaaaaatatggaaggcgacccgctgattaaatcaaaaatcaggcaaaagcaacgcgaaatggcgatgcggagaatgatgcaggaagtgccgaacgccgatgtcgtcattacgaacccaacgcattttgccgtctgcctccgctacgatgaaacaaagagcgatgcgcccatcgttgtggcaaaaggagcggacttccttgcccaaaaaatcaaatcgatcgcaaaagagcatgacattgtcatgctggaaaacaggccgctggcaagggcgctttatgagcaggtggaagttggcggacgcattccggaacagttttttaaagcagtagcggaaattttggcgtacgtatacaaaatcaagcataaaatttaagctttttcatgcaagttaggagagaaaccgtatgagtgcaagagatttgagagatattcccgtgatcgcaggtgtcattttaatcgtcactatgctaattatcccttttccgacatgggcattgagctttttaattatatgtaatatttctcttgcattgatggtacttttaatctcaatgaatatgaaagagccgcttcagttttccgtctttccgtcattgctgctcattttaaccttattccggctcgggctgaatatctcaaccacccgctcgatcctttccaccggcaatgccggcggggtcattgagacgttcggatcgttcgttgtcggcggcaacatcgtcgtcgggctagtcgtctttacgattttgattattatccaatttattgtgattacaaaaggcgctgaacgggtggctgaagtcgcggcccggttcacgctcgatgcgatgccgggcaagcaaatgagcattgatgcggacttgaatgccggcatgatatccgatcaggaggcgcgcgctcgccgggaaaaagtcagccgggaagcagacttttacggcgcgatggacggtgccagcaaatttgtcaagggcgatgcgattgccagcatcattatcgttctcattaatcttatcttcgggatcattatcggcatgacccagctcggcctctccattagtgatgccgcgagccagttttcgctgatgaccgttggcgacggcattgtcagccaggtgccggctctgctcatttcgacagcaaccgggatcgtggtcacgagggcggcatcagacggcaatcttggccaggacgtaatggcgcagatgctgtcctatcccaaaatgctatatgtcgcgggcggcacgatctttctgctcggcttgtttacgccgattaatgattttttaaccatgacggtggcagcggcgctgttcatcggcggtttccggctccagcaagtcccgaaaaagacggaacaggaaagcgcggagaaagcggaagaactccagcctgaggaattgaaaagcccggaaagcgtcatgagcctgctcgatattgacccgatcgaattcgaattcggctacggcctgatcccgcttgtggatgccaaccaggggggcgatttgcttgacaggattgtcatgatccgcaggcagctcgccatcgaactcggcattgtcattccggttgtccggatccgcgataatatccagcttgagccgaatgagtaccggttgaaaattaacgggaatgaacttgccaaaggcgagcttcttctcgaccattatttagcgatggcgcccggcgaagatgacggctccgttgaaggtattgagacggtcgagccggctttcggaatgccggcaaaatgggtgacggaagaacaaaaagaacaggcggaaatgatgggctatacggtcgtggaccccccgacggttgtctcgacccatattacggaaacgatccggcaaaacgcgtatatgctgctcggaaggcaggaaacaaaagcgttgattgaccatttgaaagagtcgtacccggtgcttgtggaagaggtaacaccgaacccgttgtccgtcggcgagatccaaaaagtgctggcgaatcttttgaaagaaaatgtttccatccgaaaactgccgattatctttgaaacgttagccgactatggtaaattaacaacagataccgatttgctgacggaatacgcccgccaaagtctcgcgcggcaaattacggcgcaatatgcgcaagacgggcaattaaaagtcatcaccgtttcggggaaagtagagaaattgattgcggatggcatccagcgtacggaacatggcaattatctttccctggacccgtccgtgtcgcaaaaaattgtggaatccgttgcacagcaggttgagagggtatcgcttaccggcagttccgcggtcatcctttgttcgcctgccatccgcatgtatttgcggcaaatgattgaacggttctttcctcaggtgccggttctttcctataatgaactggaagcaaacgttgaggtacaaagcacagggctggtgaacatagaatgaaaattaaaaagtttatggcgcccaatatgtctgaagcaatgaaacagatccggcttgagcttggggaccaggccgtcattttaaattcaaaagtggtccagcgcaaaggctttcttggatttatgaaaaagcggaacatcgaagtaattgcagccgttgacccggatgccgggaaaaacagcccggtacaaacggcccctgcccgtggtgaaaaacccgcgcgtgcgccggatgcctccgtccgttcagaaaaagaaagcctgcaaaaagaaatcgcagcgctgaaaaaagtggtccaagaagtgtcgaaacttgccaatcccgcttaccaaaagtatccgctgccggttcaaaaacgattaaatgctggttcgcaacaagggctggatgaatcgctgttgcttgtgatcggagatgccctgtatgaagaatgggagaaagcaaacggcaatctgacggaagacgaaattttaaagcaggcgaaggcactgcttcaaaaaaagctttctcgttttacatacgggggaagccggaaaaagtacgtgaacctgatcgggccaaccggtgtcggcaaaacgacgacactcgccaaaatggctgcacaggccgtgctcgaaaaaaaggaaaaaattgctttcattacaacggatacgtatcggattgcagcgattgaacaattaaaaacgtatgcaaacctgctgaatgtgccgctcgaagtggtctataaattgtccgatttcaaaaaagcgatcgaaaaattttccgattttgaccgtgtttttatcgataccgccggccggaattacagggagctgcaatatgtccgcgagctttcaggactcatcgattttcatgcggaaatggaaacctttctgacgttgtcgttaacgatgaaagagaaagatatgaaagccgtttttgacagttttcaaagcatcaggattgaccggtttattttcaccaagctggatgagacatccacttacggcgctgcgatcaatttaatggaacagtatggaaaaggctgtgcttatgtgacaaacggccaggatgtccctgatgatatgctcgaggcaacccccggtatttttgccgaatacgtatttggggagaacgacaaatgagagaccaggcagaacagctgcgcgcaaagttaaaaatgcaacacgggattccggcaaaaacgcttgcagtcgcaagtggaaagggcggcgtcgggaagtccaacatctcggtcaatttggcaatggcacttgcagaaaggggaaaaaaagtccttttatttgacctggatgtcggcatgggcaatatccacgtccttctcgggcttgacgcaccatacacgatctcggactttatcaaccggaatatcccacttgcccaaatgatatgcgacgggccggccggtatttcttatatttctgccggcaacgggtttgcccagattgtcgagatggaagaagctgctgtaaccaggcttgtcacagagctcgaactgctccagtatgattttgattacatcattttcgatatgggtgccggcgccgcgccatcaagccttaaaattttgctttcggctgatgatatttttattgtcacaacacctgagccgacagcgattaccgatgcttattcgatgatgaaatatatttacatgcagcaattcagcgcccccctttatttaatttgcaaccgggcggaaaaagaaaaagacgggatgttgacgttaaaccggcttcaatttacagttaagaaatttttagggaaagaagtgaacattctcggcgttgtgccggaagatgcgcatgtaaaaaaagctgtatcaaggcagctgccgttttacagtgcatttccacattcagcggctgcaagaagaatcgatgaattgcttaaccgctatgtatccggcaattcggacgggcccagccagcgcgcaccggtatttatgcggaaactgagggggcttttgttgaaatcttaaacatgcatgacaataacagggcaatgaaatgacagttttgaaaaacagggggcagatttgtgaaatgggaaaaacgtaaaggaagcgaaccggaaaaaaacacgcaacctttgtccgatcctgttcaaagcggacggatagcacagaaaaaattggtttgcatcggaacatcgaccggaggcccgcgcgccctgcaaaccgttctttcttccctgcccgggaatttggaagcgcccgttctggttgtccagcatatgccaagcggatttacaaagtcgcttgccaaccggctgaatgccatttcaaacatcagggtgaaagaagccgaggatggcgaaatgctcaagccgggggcggtttatattgcgcccggggacttccatatgggcgtggaggcgcacggcgcacatctctttatccagcttgagcaatccgcgccggttaacgggcacaggccggctgtggataaaacatttgaatcggtgagcatgctaaaaaactatgaaacacttgccatcatcatgaccgggatgggttcagacggaacaaaaggtttgatcgccttaaagaatcgcgggcacgtaagagcgattgccgaagcggaagaaagctgcatcgtttacggcatgccgagaagtgccattgccgcgaaagtggtggatgaagttttgccgctggaaaaaattgcggaggcaatcatgaaatttattagtgattagggtgtggtatagatggaaatgagccagtacttggaagtgtttattgaagaaagcagggaacatatccagtcgttaaacgaaaatgtgctgctacttgaaaaaagcccggatgacttgcaaattgtcaatgaaattttccgctccgcccacacattgaaagggatgtcggcaacaatggggtatgaagatctcgccaatctgacccataaaatggaaaatgtgcttgatgccatccggaacgggaagctgtctgtaaccccggacattatcgatgtgatttttactgcggtggaccatctggaagcgatggtggaatcggttgcaaacggtggggacggcaaattggatgtgagcgggacgatcgcccgcctcgaagcggtagatcatggttcagccggagagaagaagacggagaaagaaacttcagctgcgacagcggaaaaggcggaaacagaggaagacgaatttgaccagtacgaacaggccgtgattgttcaatcggaagaacaagggtacaactgttaccagttcacggtaaaattgcgcagcgactgcctattaaaagcggcgcgggtattcatggtctttgatatccttgaaaaatgcggcgagatcatccattccgatccgccggccgaccagctggaagaagaacagtttgacaatgaatttaaagtgacactgatctcaaaagaagacagggaagagattcgcgaaaaaatctgcaaggtgtcagagattgaagatgttaaagcaagcaccgtgactctcacaaagcaggatgggcgcggtcaacacccggaaacggcagaatcggagaaaccggcagaaccagagcagaaaaaacaggcagcaccggacgcagcggaaaagcatccgcaaaaaccggcaaaaaagcatccgcaaaaacagaaacatacaaccaagacgatccgtgtgaacatcgagcggctggataatctgctgaatctatttgaagagctggtcattgaccgcgggcgcctcgaacaaattgcaaaagaagtgaaccatccggagctcaatgaaaccgttgaaaggatgtccagaatttccggcgacttgcaaacgattattttgaacatgcggatggtgccggtcgaaacggtgtttaaccgttttccgcggcttgtccgccagctggcaagagaattgcacaaaaaaatggatctcgacattatcggcgccgaaacagaactggaccgcaccgtcattgatgaaatcggcgacccgcttgtccatctgatccggaattcgtgcgaccacggcattgaacagtcggaagaaagaaagcgggcagggaagccggaaacaggaaccattacgttaaaagcttatcacagcggcaaccatgtgtttatagaaattgaagacgacggcgccggcattaaccgtgaaaaagtgttggaaaaagccattgaaaaaggcattgtcaaaaaggaagaagccggcagtttaacagacagccagatttataacctgatttttgaatccggtttttcaaccgctgaccatgtatccgatatttccggccggggtgtcgggctggatgtggtgaaatcaaccattcaatcattgggcggctcgatttctgtccattccgcagaagggcgcgggtccgtctttacgattcagctgccgcttaccttatcgatcatttccgtcatgcttgtggaaatcgggacggaaaaatatgctgttccgttatcctctattgtagagacggccattattaagaagggcgaaatattaaaagcgcatcaccaaaaagtgatcgatttccggggcaaagtggtgccgcttgtctttttgaatgaaatatttgaagttccggatgcaaagcaaaatgatgaatatgtctccgtactgattgtgcgaaaaggggaaaaactggctgcatttgtggtggacgcctttatcggccagcaggaaatcgtattaaaatctttaggaaattatttaacgaatgtatttgccatatcaggcgccaccattcttggaaacggccaggttgcccttatcatcgacagcaatgcgctgatcaaatagaaaacaaggcgcttgccgcccatttcattgcccaggaaagaggttgagatcgttggagaaagtgatcgtatttcagttgaatgataaagagtatgccctgccggttacgcaggttttggccattgaaaagctgcagcatattacaagagtgccgcttaccgctccttttatacttggcgtgatgaatttacgcggtatcattattccggtcattgatctgaaaaaacggtttggcatggaggatgacacggacgctgataaggaggaacgcaagctgatcatcgtccggtttggagaaattgaaacgggcctgcttgtggacgaggcgacggatgttctggatatcgacgaaaaaaaagtggaacccgagccggaagtggtaaacgcgggcaaagaggactttatttccggtgtggcgaatataaaccagaggcttttgctgctgcttgatttagaaaaaactttaacgccattacaataggggtattttaaatggatattaaaaataaaatcacaaatcttcaccttgatgtcttaaaagaaatcgggaatatcggagcgggacatgccgcaacggcgctttccaaattgctgcataaaaaaatcaaaatgacggtcccggatgtccatattgcctcctttgaagaaattatggagctgatcggcggcgctgagctcgttgtggtgagcgtgtttttgcggattgaaggcgatgcgcccggcaatatttttttcatcgtgccggttgcccagggcgaaagattcattaaagaaatgatcgaggatccgtcgttctcctttgaaaagccgccatacccggagctcgggctgtcggcgatgctggaactgggcaatattttgtcggggtcttatttaacggcgctttccgattttacgaagctggatatgctgccttccgtcccggcactcagcattgatatgttcggttccattatcagctatggtttgattgaactgtcccaggtcagcgattatgccatcgtgattgatacagtgctgagcgatgagcaggcggaaaattccgatatgaaggggcattttttcctctttccggatccggattcttatgaaatcctattccgtgcgctaagggttgaattagatggatagcgaaatgaacattgtcaaagtgggcattgcggaaatgaagatcgtcacttctcccggcctgatcaggacaatcgggcttggctcatgcgttggcgtcgttttgtacgatttgccggctaaaacagccgggcttgcccatgtaatgctgccttcatccttcattgcgaagaatggagagcatatgaataaagcaaaatttgcggataccgctatttttgaactgatcggcatgctgaaaagcgcaggctgccaccagagcagactgctagcaaaaatcgccggcggagccgaaatgttttctttttcttccatgaatgaagcgatgcggatcgggccgcgcaatgtcgaggctgtaaaacaggaactgaaaaagtaccgcattcaattggtggccgaagataccgggggaaaaagcggccgcacgattgaatttaacccgggaaatgccgtactgaccgtgagaacggtcaaccagggttctgtcgaaatatgacgaggccgcccctttgttttcgggaaaagcgatggcaacaaggagggatgcgatatggcggaggagccaaaacagggtgaggagcagaaagattgggatttgtggcttaaatcccgtgatccggaagccgggaatgcccttgtgaaaagatatatgccgcttgtttctttccatgtccaaagaattgccgccgggcttccccgcaacgtgtcaaaagaggatttaaaaagccttggcatgttcgggcttttggattcattaaacaaatttgatccgtcccgcgaactgagatttgatacatatgcttcttttcggatccgcggcgcgattttggacggcctgcggaaagaagactggctgtcaagaggcacaagggaaaaagcgaaaaaaattgaaagcgccattgaaagtctcgagcagaaatacttgcgcaccgtttctccaaaagaagtcgctttggagcttggcatggaagaaacggaagtctgcacaacgatgaatgaacagttttttgccaatgtcctgtcgattgaagaaacgggcaccgataatgatgaaccggaagcagcatcccggttcgtgtccggggacaggaatgccggccagccggaatccgagctggaaaaaaaggaaaccgtaaaggaactggcggaggccatctgtgccctgtcggaaaaagagcagcttgtgctgagcctcttttatcaggaagaatgcacgctgacagaaatcggcgaagtgatggggctttccacttcccggatttcccagatccattcgaaggccatttacaaactgcggaatattttggaaaaacggctgctgtaatcagagggggtgaatcaaacggttatttttttcctcattctttctttcctatttaatgtgctctccatttttgccatcatcctgctctatttacggcaaaaccgctttgcccgggcagaacaaaacgtcaataaaatggtgaaagaaattgaagacatcttttccgtatacctgatggagttaaaagaagaaaacgatgctttcatcaaaaaaatgaaagcaggcaggatgaaagaggcaagcccggcggaaaaagcagggccggaaacgggacagccgggttcggaaacaaaacaaccgcctgagacagaagaaacagcggaactgaagtcagatgcgctcatccaggtatccgcaaaccgggcgtaccggaatgcggcccggcaaatttcaggggaacaaagcgatgggcagcttcaggaagaaaaaagccttttgcaaaaagtgaatgatttgcaacaaaacgggtatactgttgatgaaattgcccaaaaattaaataaaggccgcacggaaatcgagctgcttctcaaatttcagacaggacgcggataatgcttgattcgcatttttttttatggtatagtaatcgttggtgttatcacacacgcttcatgatttaaaggacggtgctgcttttaagcggtctccttttgaaaaggattggggcggaggaaaaaaaccataggaggaaataaaatgtcagtaatctcaatgaaacaactgctcgaagccggtgtccatttcggccaccagacgcgccgctggaacccgaaaatgaaaaaatacattttcacggaacggaacggcatctatattattgacctgcaaaaaacggtcaaaaaagtagaagaagcttataactttgtaaaagatcttgcaggcaacggcggaaatattctgttcgtcggcacgaaaaaacaggcgcaggaatccgttaaagatgaagcggaacgttccggcatgttttacgtgaaccaccgctggcttggcggaaccttaaccaactttgaaacgatccaaaaacggattgaccgtttgaaacaaatcgaaaaaatggaagaagacggcacatttgatgtccttccgaaaaaagaagtcgtccagttgaaaaaagaacacgaccgtttggtgaaattccttggcggcattaaagatatgcggaacctgccggatgcattgtttgtaatcgatccgcgcaaagaacgcatcgcggtagcggaagcaagaaaattaaacattccgattatcgggattgtggatacaaactgcgatccggatgaaattgactatgtcattccggcaaacgatgatgcgatccgtgcggtcaaacttttgaccagcaaaatggcggatgctattgtggaagcaaaacagggcgaagaaggtgccgctgaagttccggccgaatccggcgaagcagcgggcacggaagaaacgactgtcgaagcctgatccgttttccggccggggtttgacagcggccgcaccttacccaaaatatcccaataaaaaaggtgataagaaggtttgtgcttatcacctttttttagggagacgtacataaacttgaaggaggaaatccgatggcaattacagctcaaatggtgaaagaacttcgtgaaaaaaccggcgcaggcatgatggattgcaaaaaagcgctgacggaaacgaacggcgatatggaaaaagcggtggactatcttcgtgaaaaagggatcgcaaaagcggcgaaaaaggcagaccgcgttgctgcagaaggaaccacttacgtattaagcgaaggcaaccacgccgtcattctcgaagtcaatgccgaaacagactttgttgcaaaaaatgcagaattccaaaaccttgtaaaagaaatcgctgaacatttgcttcaaagcaaaccggccgatctggatgccgctttacaatcaacaatggcaaacggatcgactgtcaatgattttattacacaggcgatttccaaaatcggtgaaaaaatttcgctccgccgttttgccctgaaaacgaaaacggataacggtgcgttcggcgaatacctccacatgggcggccgtatcggtgtgctcactgttcttgaaggcacaaccgatgcttctgttgcaaaagacgttgcccttcatgttgcagcgatgaatccgaaatacatctcccgcgaccaggtttcggaagaagaagtggcccatgaacgcgaagtattaaaacaacaggcgctgaacgaaggcaaaccggaaaagattgtggaaaaaatggtggaaggacgcttgaagaaatacttcgaggaaatttgtgtggcagaccaggcgtttgtcaaaaatccggatcaaacggttgggcagttcgtcgcttcccataatgcaaaagtggcagattttgtccgttatgaagtcggcgaaggcattgaaaaacgccaggaaaactttgctgaagaagtcatgaatcaagtgaagaaaaactagttttaaaaggggaacacagtgtgttcctctttttaaaagaaggcaggattttaaccttgcaaaaaaaacgccccgtttaccggcaaagatggaccggggcaattttacataaccatattggaggttcaaaatggacacccctaaatataaacgtgtcgtattgaaattaagtggtgaggcattggctggagagcagggctttggtattcatccgacggtcatccagtccgtcgcgcggcaagtaaaagaaattgtcgagcttggcgttgaagtggcgattgtcgtcggcggcggcaatatttggcgcggcaagatcggcagccagatgggaatggacagggcaacggctgattatatgggcatgctcgccacggtcatgaatgcaatggcccttcaggacagcctggaacagagcgacgtggaaacacgcgtgcagacttccattgatatgcgccaggtggcagaaccttatatcagaaggcgggccatccgccatctggaaaagggtcgtgtcgttatttttgccgccggtacgggcaacccgtttttctccaccgatacgaccgccgcgctgcgtgcagcagaaattgaagccgatgtcattttaatggcaaaaaataatgtggacggtgtttattctgccgatccgaaactggacaaagatgctgtgaaatatgaagagctttcatatctggatgtcatcaaagacggcctcgctgtcatggactccaccgcgtcctctttatgtatggacaatgacatcccgcttatagtattctcaattatggaggaaggaaacatcaaacgcgccgtcttgggcgaaaccattgggacaatcgttagggggaaaatatgatggcaaatcaggtcattgacactgcaaaagataaaatggcaaaagcaatccaggcttttcagcgcgaactcggctccatccgtgcggggcgtgcaaacgcggccctgctcgataaaatcacgatagattactacggcgctaggacacctgtaaaccagcttgcgtccatttccgtgccggaagcgcgcctgatggtgatccagccgtatgataaaacggtgctgggtgaaattgaaagggccattttaaaatcggatctcggccttacgccgaataatgacggttccgtaatccgcctttccatcccgcctttaacggaagaacgtagaaaagaactggtgaagctcatcaaaaaagaagcggaagaagcaaaagttgccatccgtaacgtgcgccgtgatgccaatgatgaactgaaaaagcaggagaaaaacggtgagattacagaagatgagcatcgtggtttcgcggaagacgttcagaaaatcaccgaccagcacattcaaaaaatcgataaaatgacaaaaacaaaagagcaggaaattatggaagtctgactgccggacaaaaaacttccgttggcaagcggccgatggaagttttttattatgttatcagtgcgcgcttttcccgggagcatggaatgttccggttctaaaatcctgtcatattgccggaaaatggggctacacacgcgtttaaaaggggatacaaagccggttttccatacacccccaaaccaaatggccggatcgtttaaaaaacagaactacacaaacgcatccattttctctataatagaggttggcaaatggaatacaaaggtcataccacttttgccggaaacgactgaacacgtatggccgcggtaccgtgcataaagttgcaggcggataccatttggagggcaaatgtgcatatgaatttaaaaagatggaaatctttcgataaagaaggccgcgacacgacaacccgcggcgaaaaagtgaaagctgccgccatcccggaacatgtcgccatcatcatggacggcaacggaagatgggcgaaaaaacgccatttgccgcgggtggccggccatcacgaaggcatgaaaaccgtccggaaaattacccgtatcgccaaccggctcggaatcaaagtattgacgctgtatgctttttcaacagaaaactggaaacggccaaaattagaagtggaatacttaatgaagctgccggaagaatttttatccacttatcttcccgagctgaaagcggaaaatgtgaaagtgcagatgatggggtgcaaagaaaaaatcccgcttcatactcaaagggccatcaataaagcgatcagtgaaacggcgcaaaacgacgggctgattctcaattttgcgttgaactacgggagcagggatgaaattatgcgcgccgtgagaaatattttaatggatgtaaaaaatggtataatgaatgaaaacgagctgaccgaggaagtgttccaccagtacttaatgacgcacggcctgcaggaccccgaccttttaatccggacgagcggggaaatccggctcagcaattttatgttgtggcagctggcgtatacggagtttgtgtttaccgatgtgttatggccggattttaatgaggaacattttttaagtgcgattgaagaatatcaaaaacgttcccgaagatacggcggtttaaaaagtgaggagcagtctgaatgaagcaaagaatcattacagccatcgtggcagcagctttttttattccttttgtgatatacgggagatggccgtttgcgctgctcgtgtatgccatggcgaccgttgcgctatacgagctgttgcggatgggaaaacagtcatttttttcctttggcggcctcctttccgtcctgctgctttggctgattttatttccatcaaagtatatgcatgtcatcgcacaaacaggcttttcaaagcttgaattggtgtatatgatcgtgctgctttttcttgcctacatggtggtgacgaaaaaccggtttacatttgagcaggctggtttccacattttgtccgccatctacgttggcatcggcttttattattttattgaaacaagaaatgcgccagatgcgggcataacctatattttttacgccctgtttctcatttgggcaacggattccggcgcttatttcgtcggacgggcttttggaaagcataagctgtggccagagatcagcccgaataaaacggttgaaggcgcgcttggcggcgtactgtgtgcggtcattgttgctgtgctgttttttttctattccaatatcggcctcgggctcgggcggctcatggtgtccacggtcgtcctctccgttttcggccagatcggggatttggtggaatccgcgtataaacggcattacggggtaaaagacgcagggaaaatcctgcccgggcacggcggcattttggaccgctttgacagtttattgtttgtcctcccgcttatccattttttaaaaatgatggcgggatagaaaaagaggtggatagcattgaagcaaatcagcttattgggggcgacgggctccattggtacacaaacgctggatgtgatccggaaccatccggaagcattccggctcgcggccttttcagcagggagaaatctcaatttaacgaggaaaattatttcggagtttcatccggcgcttgtctctgtcgctgacaaagaagactgtgcccggctgaaaaccgaattcggggacagcccggttgtgctctacggggaaaaagggatggtcgaaacggcggtatatgccgaatcggatattttggtcaatgcggtgcttggcagtgtcgggctgttgccgactttggaggcgatccgggcggggaaaactgttgcgatcgccaataaagaaacgctcgtcacagctggccacctcgtgatggatgcagcaaggcgcgccgaaactgaaattcttccgatcgacagcgagcattccgccatttttcaatgtttgcaaggggaaaaccgggatgagatcgaacggctcatcattaccgcatccggcggcagtttccgtgattatacaagggaacagcttgaaaccgtcaccgtaaaagatgcgctgaaccacccgaattggtcgatgggcgccaaaatcacggttgattcggcaacaatgatgaataaagggctcgaagtcattgaagcacactggctgttcggccttccctttgaaaaaattgatactatcctgcaccgcgaaagcatcatccactctctcgtcgaattccgtgacagcagcgtaaaggcgcagctcgggatgcccgatatgcgcatcccgattcaatatgcgctcggatttccaaaaaggttgccgctaccggatgcaaagcggctcgatttggcggaaatcggccggcttcattttgaaaaaatggatgaagaacgcttttactgcctgaaacttgcctatgaagccggaaaagccggcggatcgatgccggccgtgctgaatgcggccaatgaggtggcggtccatgcctttttgcaggaaaaaatttcgtttttgcaaattgatcagttgattgaaaaggcgcttgcaaggcataatgtaattatacaccctgatttggaaacgatctgggccgttgaccgtgagacgcgggactatgtggcctcgctcatataagcgggagcttgcccggagttcctgaaaaaggcggagactattttaaagtaaggtggtattcatttgacgacagttatagcctttattttgatttttggttcacttgtcattttccatgaagccgggcatttctttgttgccaaaaaagccgggattttatgccgcgaatttgcgatcggattcggcccgaagatcctttcgtttaagaaaaacgaaacgcagtataccgtccgcctgcttccgatcggcggatacgtacggatggcgggggaagacccggatatgccggagttgaagccaggccagcgggttgggctgcttttcgatgaaaacgaagccgttgaaaaaatcgtggtgaacggaaaagaccggtataccggattgcgcatgattgaaacggaatctgcagatctggaacgtgcgcttgtaatcaaaggctatgaagaaggcgatgatgaacacctccggacgtttaaagtgaaaagggatgccgtgcttgtcgaagaccggatggaaatgcaaatcgcgccttgggaccgccagtttgcctccaaatcgcttgggaagcgggcgctcacgatttttgcgggcccgctcatgaatttcgttctggcagcccttgtctttacccttatggccgtggtgcagggggtgccgatgaccgatccggtgctcggaacggttgtcaaggacagtgctgcggcaaaggccgggctgcataaaggggatacagtgatcagcattgacggtgccgaaatctcgacgtggaatgacattgtcgacgtgatccaaaaacaccctgatgaaaaaattacgtttacagtggaacggaacggcaaaacaatggacattccggtgacgccaaaaagcatttcagaggacgggaagaccatcgggagaatcggcgtgaccagcccggttgaccattccccgctgaaagtagccacgtacggcattacacagacatacgtttggacggtggaaatttttaaactgcttggccacctgatcagcggcggcttttccattgatatgctgtcaggccctgtcggcatttacaaatcaacagagaccgtcgccaagtcgggcatcatttatttgtttaaatgggcaggattgttgagcatcaacatcgggattatgaacctgctcccgctgccggctttagatggcggcaggctgctgtttttcggcatcgaagcattgcggggcaaaccgattgaccggcaaaaagaaggcatcgtccattttatcggttttgcgctcctgatgctgttgatgattattgtcacctggaatgatatccaaagatttttcctgtaaagtttccggtttcgagggggttccagcgggccctgttgcaaaagggcctgcttccttacctgctttacggagacggttataaaatggatttgcatttttgatccgccattagcccggtttggcccgctcgtcttcacaagcaacgccaaatcttcgtatttttaccgtgcggatcccttttaaaatctgcatttctagcaccctggcccggcttttgatttacaatctcttaccatccaaccttggacctggtttgctgaatcgggggaatagaaacgaaggaacgtaatcaacgcgactgatctataataaatgaatacgggagtgcgatgtatgaaacagagcaaattgtttattccgacattgcgggacgtaccggcagaagccgaggtgaaaagccatcagctgctgctccgtgccggttacatacggcaaattgcaagcggtgtttatacgtatttgccgctcgcgaaaaaagtcttacataaaattgaagcgattatccgcgaagaattggaagctatcggttccatggaattgctgatgccgtccctccagccggcggaattgtggcaggaatcggggcgctggtattcttacgggccggatttgatgcgccttaaggaccggcatgaacgggactttgcgctcgggccgacgcatgaagaagtgatcacaagtttaattcggaacgaagtaaaatcgtataaacgcctgccgctttctttataccaaattcaaacgaaatttcgggatgaaaagcgcccgcgtttcggcttgctgcgcggacgggaattcatcatgaaagacgcgtattctttccatgccaacaaagagagccttgatgagacgtataaggatatgtatcgggcttataccaatatattctcgcggtgcaaactggatttccgcgccgtattggcggactcgggcgcgatcggcgggaaagatacgcaggagtttatggtgctgtctgaaatcggggaagacaccattgcgtattccgactcatccgattatgcggcaaatattgaaatggcggaagtgaagaccgtttacacaaagccggatgaagcggaaaaaccgctcgaaaaaattccgaccccggggcaaagaacgatcgcgcaaattgcggactttctaaaggcagatcctgaaaaatgcctgaagacccttgtgctgaaagcggatgatgaatatgtcattgtgctggtcaggggcgatcatgacgtaaatgaagtcaaagtcaaacatcttctcggttctgaaacgattgaaatggcagatccggaagccatcaagtcgatcatgggggcggatcccggttcgctcggccctgtcggcgcgccggaacagatccggattttggccgatcacgccgtccgctatgtagtcaacggcatttgcggtgccaatgagaatgacttccactatgtgaatgcgaatccggagagggattaccgcgtcgatctatacggggatctccgcaatatccaggaaggcgacccgtcaccggacggaaagggaacgatccggtttgcacgcggcatagaggtcgggcatattttcaaactcggcacaaaatacagtgaggccatgcacgccgcctttttagacgaaaacggcagggagcaggtcatgttgatggggtgttacgggattggtgtctcccgcactttaacagcagtgtgcgaacagcataacgatgataaagggcttgtttggcctgtcaatctggcgccgtttgacgtgcatctcgttccggtaaatatgaaggatgcccaacaatccgcccttgcagaatcgctccatgcggaacttgaaaagcagtttaccgtcttgatggatgacagaaacgagcgcccgggtgtgaaatttgcggattccgacctgatcggcctgcctgtccgggtaaccgtcgggaaaaaagcggcggaaggcatcgtcgaagtgaaaatcagaaaaaccggggaagtgctcgaagtgaaaaaagaggatttggccgagacaatttctaatattttagcacaacttgcttcatgacaggggcatcggcttaccggccggtgcttctcttcttttcctgcaaaaaagaggcagaaaatgttttgcctggaaaatttcaacacccgaacctttcaacactaccgggaaaaattccggaaagattgcattcgggacgcttgttttttaagataaagatagattgaatgaaaaaggatgggagaggacaagatgattgaaaatcccgccggaaagaaagaaaggttccagattttgctccggcagctggaactgcttgatgacaggttttacgagcattttaaatacggagaaattgaaaaactagttgtggaacgccagtcaaagcgatggcatttttattttttgctcgaaaaaattctcccctttgaagtgtacttgacatttacaacccgtttgcgccaggcttttcagcatattgccgacgtccgtttttcaatccgggcgaaagacccttcttttgggccggcgctgattgccgattactggaaagcgtgcctaggagaactggaaggcatgtcgccgatgcttttgtccctacttgcggagcaggtgccgtcactttccggcaataagctggtggtaaccggccgcaatgaaccggaagcagcgacattaaaacaaaaatacggggaatggatcgtccgtttttacgaacgggccggttttccgcagctgatgtttgacacggaaatttcggcggcacctgaagcaagtgaagcatacgccaaatttatggaagaaaagaaaaaagaagatgaggaacgggcaaaacaggccgttctcgaaatgcagaagcacgtgaatgagcaacagagcggggaagaaacgcacgacgcgggaccgcttatgatcgggctgagaatcccgcccgatgatgatatccgccgcctttccgagattgttgatgaagaacggcggattacggtggaaggctatgtgtttgacgtcgaaacgaaagaactgcgcagcgggcggacgcttttgacgttaaaaatcaccgattatacgagctccattctcgtgaagatgttttcgcgggataaggaagatgccgcacaatttgcccgcgtgaagaaagggatgtggctgcgtgcgcgcggcagcatccagaacgatacgtttgtccgtgatctggtcatgatcgccaacgatctttctgaagtagccccgcgcgtccggaaagaccatgcgccggaaaatgagaagcgggtcgaactccatctccatacgccgatgagccagatggatgcggtcacttccgcgtctacccttgtcgcccaggcaaaaaaatggggccatccggcgattgcgatcacagaccacgccgtcgcgcaaagttttccggaagcttacagcgccggcaaaaagaacggtataaaagtcatcttcggcgttgaagccaatcttgtcgacgacggggtgccgattgcctataatgatgcgcacgtccaccttgatgaagcgacatatgtcgtctttgacgttgaaacaacgggattatctgccgtttatgatacgatcatcgaaatcgctgcggtgaaaatccaagacggcgaagtggtcgatacgtttgaacggtttgccaatcccggacgtccgctgtccaatacgattattgagctgacccatattaccgacgatatgttaaaagatgcgccggacatttccgaagtgttgaaagaatacaatgaatggattggcgacgcggtgcttgtagcccacaatgcttcgttcgacatcgggtttttaaacgttggcctgaaaaaagccgggctgccgaaatccaataaccccgtcattgatacgctcgaactcggacggtttttatatccggatttcaaaaactaccggctgaacacgctcgcgaaaaaattcaatgtggaactgacccagcaccaccgcgcaatctacgatacggaagcaacaggacaaatctttttaaaaatgctgaaagatgcccgtaaccgggggatcacataccatgacgagctgaaccagtatatgggggaaggcggcgcgtacaagcgggcgcgcccgtcgcactgcacgctgcttgtccggacgcaggaaggcttgaaaaatttatttaaactgatttctctttcccatatcgattacttttaccgtgtgccgcgtattccgcgttccgagctgcaaaagtaccgggaaggcattctcgtcgggtccggctgtgacaaaggcgaagtatttgaaggcatgatgcagaaagatccggcggaagtagaggagatcgcccgcttttatgattatcttgaagtccatccgaaagaagtgtacgccccgctcatcgaccaggaactgataagggatgaaaaggcgcttgaagaaatcatcacgaaaatcgtcaggctcggggaaaaattaaatctgccggttgtcgcaacaggcaatgtccattatttaaaccccgaagacaaaatttaccggaaaatcctgatcagctcccagggcggtgccaatccgctgaaccggcaccggctgccggacgtgcatttccgcacgacggatgaaatgcttgcatgcttctcgtttttaggcgaagaaaaggcaaaagaaatcgtggttgacaacacgaataaaattgccggcttaatcgaggacgtcaagccggtaaaagatgagttgtacacgccgaaaattgaaggggcggaagaagaaatccgcgagcaaagctataagcgcgcgaaaaggatttacggggatccacttcccgaaattgtcgaagcacggcttgaaaaagagctaaaaagcattattggtcacggatttgcggtcatttatctgattgcccataaacttgtcaagaaatcattgaatgacggttaccttgtcggttcgcgggggtctgtcggctcttcgcttgttgcaacgatgacggaaatcaccgaagtcaacccgctcccgccgcattatgtgtgcccgaactgcaagcattccgagtttttcaatgacggttcggtcggttccggttttgacctgccggataaaaactgcccggcgtgcggggcaaaatacaaaaaagacggccatgatattccgtttgaaacgttccttggctttaaaggggacaaggtaccggatattgacctgaacttttcgggcgattaccagccgcgcgcccacgcctatacaaaagtgttgttcggcgaagagtatgtataccgcgccggcacgatcggcacggttgcggaaaaaacggcctacggctatgtaaaagggtatgcccaggaccataatctgacattccggagcgcggaaattgaccggcttgtccagggctgcaccggggtgaaacggacgaccggccagcatccgggtggcattatcgtcgtcccggattatatggatatatacgattttacgccgatccagtatccggcggacgatcacaattcggaatggcggacaacgcattttgatttccactcgatccacgataatattttgaagcttgatatactcgggcacgatgatccgaccgtcatccgcatgctccaggacttaagcgggattgacccgaaaacgatcccgaccgatgacccggaagtgatgaaaattttcagcgggccggaaccgctcggggttacggaagagcagattatgtgcaaaaccggcacgctcggcattccggaatttggcacaaagtttgtgcgccaaatgctcgaagatacaaaaccgacgacttttgccgaactggtccagatttcagggctttcgcacggaacggacgtatggctcggcaacgcccaggaactgatccaaaacggcacatgcaccctgcctgaagtaatcggctgccgggacgatattatggtctatttaatctatcagggcttagagccgtcccttgcttttaaaattatggaatcggtacggaaagggaaagggctcacgcctgaaatggaagaggaaatgatcaagcaaaacgtgccaaattggtatattgaatcgtgcaaaaagattaaatatatgttcccgaaagcccacgccaccgcctatgtgctgatggcggtaaggatcgcttacttcaaggtgtaccatccgctgatctactatgcgacgtattttacggtgcgcgcggaggatttcgatctcgatgtcatgatccacggctcgaattccatcaaggcaaaaatcagtgaaattaatgcaaaagggatggacgcatcggcgaaggagaaaagtttgctgaccgtgctcgaactggcgcttgaaatgacggcgcgcggcttccgcttccagccgattgatttgtatcgatcggaagcagacaagtttgtcattgacggcgattcgctcattccgccgtttaatgcgattccgggtcttggtacaaacgccgcggtcaatatcgtaaaagcgcgtgaagaaggtgaattcctttcaaaagaagacttgcagcgccgcggaaaagtctccaaaacgattatggaataccttgacgggcacggctgcttagagtcgctgccggagcagaaccagctgtcgcttttctaaatacgggttaaggaccgctgtttgcttttttttgcctgttatggtatagttttttatggaaatactacggataaacgctcgtgcgaaagagtggggccatcaccccgctctttcgtgttttaaatcggatttttgaggaggtcagcatgagtaaagtcgttgaagtggtggaacaactggcatccccggttgtggaagggctcggccttgaacttgttgatattgaatacgtcaaagaaggaaaaaactggtttcttcgtgtttatattgacaaagaaaacggggtcgatatcgaagaatgcgggctcgtcagcgaacggctcggggaaaagctcgatgaagcggacccgattccccataattatttccttgaggtttcctccccgggtgcggaacgcccgttaaaaaaagcgcgtgactttgaacgtgctgtcggccggaccgtcctcgtgaaaacgtatgaaccgcttgacggggagaaaacgttccagggaaaattgattgcttttcacaacgggtgcctaacattagaatgtaaagtgaaaacgaagaaaatcgagaaggaaattccgtatgacaaagtggccaacgcacggcttgccgttgaattttaaaaatgcatcatttttcaaaaaatgaagggggatccaatttccatgagctcagaactggtagatgcgcttacgatacttgaagaagaaaaaggaatttcgcgggatgtgctcgttgaagccatcgaagccgcgcttgtatcggcataccgccgcaattttaaccaggcacagaatgtaaggacggatttaaatctggcgaacgggacgatccgtgtgttcgcgcgtaaagacgtggttgaagaagtatttgacccgcgccttgaaatttcgcttgaagatgcccagaaaatcaatccgtcttatgaaatcggcgatgttgtcgaattggaagtcacgccgaaagattttggccggatcgccgcacagacagcaaaacaggttgtcacgcagcgcgtccgggaagcggaacggggaatcatttacaatcaatttatcgaccgtgaagacgaggtcatgaccgggattgtgcagcggaaagatccgcgttttacgtatgtcagcctcggaaaaacagaagcactgctgccgccgggggaacaatccccgaatgaaacgtacaacccgcatgaccggattaaggtctacattacaaaagtcgaacggacaacaaaggggccgcaaatttttgtctcgcgcacccatcccggccttttaaaacggctgtttgaacttgaagtgccggaaatttacgatggcatcgtagaaatccgttcgatcgcccgcgaagcaggggaccgttcgaaaatttcggtttacaccgaccgcccggaggttgatcctgtcggcgcatgcgtcgggcctaaagggcagcgcgtccaggcgattgtaaatgaacttcacggggaaaagattgatattgtaaaatggtcggacgacccggctaaatttgtagcaaatgcgttaagccctgcaaaagtgcttgatgtgcttgttgacgaaaacaataaggctacaacggtcatcgttccggattaccagctgtcgcttgcaatcgggaaacgcggccaaaacgcccggcttgccgcgaaactcacaggctggaaaattgatattaagagcgaaacggatgcaagggagtcaggcatttatccgcgttctgaaaccaatgatgacatagacggggaaacaccggggctttttgatgacgatgatgccggccgcacttccgaagcactggccgtaccggatgcgaaagaagcggatctgcctgaaaacggcgggaaagatgaagagatcgaataaggagtggggctgatggcgacacgtaagaaaattccgatgagaaaatgcgtagcaacgggagaaatgaaaccgaaaaaagaaatggtccgtatcgtccgttccaaggaaggcgatgtttcgattgacccgaccgggaaaaagtcaggaagaggcgcctatctttcaaaagacgaggaagcggtgctgttggcaaagaaaaaaaatattctctcatcccatcttggtgccgctgtagaagatgctttttacgatgaaatcatcgcgtttattcaaaaggaaaaaaaggagaataaacaaaaatcatgaacgggaagcaggcaatgtcccttttaggccttgcgttcaaggcaggaaagatcgtttcgggagaggagcctgtcctgaaagaaatccgggcaggccaggcaaaacttgtattgctttcaaaagatgcctcatccaatacgtcaaaaaaattgttagacaaatgccgtttctatcatgtaccggtacggtggatagagacgagggaaatgcttggaaaagccattgggaaagaggcgagagtcgcagtggcagtaagtgaccgcggatttgcggaaaaacttgctgaactgctcgatgaatcataggtgggggtgacgacatgagcaaaatacgtgtttacgaatatgcgaaagctcatcatacatcaagtaaggaaattatcacgaaactaaaacaaatgaatatagaggtatccaatcatatgtcaatgatcgatggggaaacagtaaggaagctggatacggtttacagcggcaaaaatcagcaggatggcaagaaaaacgggcaaaacgggccgaccagaaatgaaagaagcaccaggtccgaaaccggggaccgacaaggaaacaaacccgaaaaccgcacccggcgcgaaaaccagaagccgaatcacggaaacggccaaaacagcaaaaaccaaggggataacggaaacagcagaaacaataacaataaccgctctggcggcagcaaccgcagcgatgggaagagcagaacgggcggcaacaatcggaataacaggaacggccaaaccggcggcaacaaccggagcaatggaaacacccaggccgcaagcaacaaccggaataacgaaaaaagccaggctgcaagtaacaaccggaataacggaaacagccagaacacaagcaacaaccggagcaatggaaacacccaagccgcgggcaacaacaggaataatcaaaacagcgggaacagccggaacaacgggaataaccgcaacagtggcaatggaaaccgtagcaataacggaaaccgcggcaacaacggacggccgtttaacaaacaaaagaaaaataaccggaaaaataaaaacttcaaaccgcagccgcagccggtccaaaaggtaaaagaactgcctgaaaaaattacgttcacagaatcgctgaccgttgcggaacttgcgaagaagctctacagggaaccttccgaaattattaaaaaactgttcctgctcggcgttgcggcaacgatcaaccagcagcttgacaaagacgccattgaactgattgcttcggaatacggcgttgaagtggaagaaaaagtgatcgttgaccagacggatctggaaacgtattttacggaagaccgtgaagaagacctcgaagtccgcccgccggttgtcaccattatgggccatgttgaccatgggaaaacgacaacgctcgattccatccgccatacaaaagtcaccgccggagaagcaggcgggattacccagcatatcggtgcataccaggtgaaagtaggcggcaaaaaaattacatttttagacacgccggggcatgaagcctttacaacaatgcgtgcgcggggggcgcaagtgacggacattaccgtgcttgttgttgctgccgatgacggcgtgaagccgcagacagtggaagccattaaccacgcgaaagcagccggcgttccgatcattgttgcggtcaataaaattgataaaccgacagcgaaccccgaacgagtcatgcaggaactgacggaatacaatctggttccggaagactggggcggggatacgatttttgtcccgatttctgctctaaccggtgaagggattgacaatctgcttgaaatgattttgcttgtcagcgaagtggaagaactgaaagcaaacccgaaccgccgcgcactcggttcggttattgaagcgcgccttgataaaggcaggggcccggttgccactttgctcgtacaaaacggcactttgcgcatcggcgacccgattgtagtcggtcacacttacgggcgcgtccgtgcgatggtcaatgatctcggccgtcgcgtgaaagaagcagggccgtccacgcctgttgaaattaccggtttaaatgatgtaccggaagccggcgaccgttttgttgtctttgaagatgagaaaacagcccgccaggtcggggaagcgcggaaacaacaggctgtccaggcgcaccgtaacgaaaccgcgcgcgtcagccttgacacgttgtttgagcaaatgaagcaaggggaaatgaaagaattaaatgtgattgtcaaagcggatgtgcaaggctctgtagaagcattgaccgccgctttgcaaaagattgatgtggagggcgtcaacattaacgttatccatacgggcgtcggcgcgattaatgaatccgatgtgacgcttgcttccgcttcgaatgcgattattattggctttaatgtccgcccggataataacgccaaacgcgcagccgaaacggaaaaagtggatatccgcctgcaccgcattatctacaaagcgatcgaagaaatcgaatctgccatgaaagggatgcttgatccggaatacaaagaaaaaatcatcggccaggttgaagtgcggcagacgtttaaagtatcacggatcggcacgattgcgggcggctatgtcaccgacggaaaaatcacccgtgacagcggcgtgcgcgtcatccgtgacggcgtggtcatttatgaaggtgtaattgatacgctgaaacgctataaagatgatgtgaaagaagtcaaccagggatatgaatgcgggattacgattaaaaactttaatgacatcaaagaaggagatgtcatcgagtcctttatcatggaggaaattgaaagagcatgattgggagcgcccgttgcgaatttcgcatttatgatgcccgttcattgaaagaaaaaagggcagtgctgcaaagaatattgacgcggctaaagcaaaaatataatgttgcagccggtgaaatggatttccaggatgcctggcagcggaccctcgttgaagtcgtgaccgttgcttcaagccgggcggcggctgaaagagaattgcagcgggcaattctctttctggattccttccctgaatgggagcgtcttgaaacaaatattgaatggctataaatgaggtgtgattgatgaatcttcgtgcaaatagggttggcgagcaaatgaaaaaagagctgagcgacattatcgggcgaaaactaaaagatccgcgtgtcggctttgtcactgtaaccgatgtggaagtaacaggcgatcttcagcaggcaaaagtgtacctcaccgtcctcggcgatgaggtacaaaagaaagacacccttgacggcctggaaaaagcaaaaggctttatccgctcggaagttggcaaaaggatccggctccgcaaaacgcctgaactgatttttgaaatcgatgaatccatcgaatacggcaaccgcattgagacgctgatcaaaaaaatccatgacacggatgaatgaatgtttcaggaaactgatcggagccggaacacggttcggtaagtttcctttttttgagtgattctattggatttgcgaaaggaagtggcgccatggatggcattttaccgctctggaaaccggcggggatgacttcccatgactgtgtttttaaaatccggaagcttttcggcacaaaaaaagcaggccataccggcacgcttgatccggatgtggaaggggtcctcccggtttgcatcgggcgtgcgacaaagattgccgaataccttcaggatgccggcaaaacttacgaaggtgaagcaacgatcgggatttcaacgacgacagaagatgcttccggcgatatcattgaaaaaaaggaaattagccggccgatcagccgggaagaaattttagccgcactcgcttcgtttaccgggcatattacccagatcccgccgatgttttccgccgtcaaggtgaacggaagaaggttgtatgaatatgcgcgggcgggcatcgaagtggaacgccctaaaaggaatgtgcaaatttacagccttgaactattggacgggcgggaatattttgaagggccggttgtgtcgttccgtttccgcgcttcatgcagcaaaggcacctatatccgcacgcttgctgttatgatcggagaaaagctcggctatccggcacatatgtccaatcttacaagaattgaagcaggcggtttttcaaaggaacaatgcgccacctttcaggagattgaaaaagccgcggaaaccggcgacagggaaagcctgctctacccgctcgaggccgggatccgccatttgccgaaatgggaaattagtgatacattagcagagaaagtaaagaacggtgccgtgttgaaaaaaccggagacctggccggaaacaggagacaggcttgctgtctttttccgcggaaaaatactcgcggtatacgtggcgcattccggcaggcccggctttatcaaaccggcgaaagtgatataaaaagccttccgggtataaaacaaggaaggcggctgcttcaatttgtaaaagggaaaaggtgagaaattttgaaaacaataacggtccatcatccccattcctttaaacccggcgattttccgccgcttgccatcgcattgggttattttgacggcatccatctcggacatcagaaagtgattaaaacagcccgcgggatcgctgaaaaaaacggatggaaaagcgccgtcatgacatttgaaccccatccttctattgtgctgggaaagaaaaaggatggcattgaactgattacaccgcttgaagacaagatcaagttgattgaaaaacttggtgtcgattatctgttcgtcgtccgttttacctcccgttttgcgtctcttttgccgcagcaatttgtcgaccaatatctggccgcactcggtgtgaaacatgttgttgctggttttgattatacatacggcaaattcgggaaaggcaatatggagaatctccctgaatatgcaaacggcaggttcgggattacggtgattgaaaaactggcccttgaaaataccggggaaaaagtcagctccaccctgatccggtcaaaaatcagggaaggaaaagtcggggaagtgaagccgctgctcgggcgcgattatgagatcaaaggcattgtcgtccatggggagaagcggggacgacagctcgggtttccaacggcaaatctaaagcttaccgcgtcgtatatgctgccgccaaacggggtatacattgtgcaaatgaaggtcgcggatacgtggcataacggcttatgcagcattggctacaatcctacgtttaaaaatccggaagaatatgaaaaaacgacagaagtgtatctgcttgatttttccgataccatttacggggaagaagcagttgtcaaatggcttgcgcgcatccgcgaagagaaaaagttcgcccgcgtggaggacttgattgaagaaatgaaacgggatgaaacggcagcaaggcgttactttgaaaaacagggaactgctacttgagttttgtgcgaaaaagtagtattctattacagtaccggaacctgtgcttggcagcgcgactcaccgacgcctgctcggcaacaggggataggaaacagaggaggtgaacaggatggcgatttcaaaagaacgtaaaaatgaaatcatcaaccaatttaaaatccacgagaacgataccggttctccggaagtgcaaattgctgtattgacagaagaaatcaacaaattgaacgatcatttgcgtgtccataaaaaagaccaccattcacgccgcggcttgatgaaaatggtagggagacggcgtaatttgttgacctatctgcgcaataaagatgtgcatcgttaccgtgaattgattaaccggctgggcttgcgccgataaaaaaatgcagaatgcaaaaagcgggagtattcccgcttttttgcaatgtgtttttccccccttaattttgggaacagatgtatttcaaattgccgccgggttttcgcactgacctggcgcggcttgtacatacatagcaaacggttgattcgtttttgaatcattacccgtgcttatctttgcataaatgtgaaacaatataggcaaaaagaaaggagattttcatctgtatggtacaggataaacatacctatacgatagattgggccggccgcccgctcaccgtggagatcggccagctcgcaaaacaggcaaacggtgctgcactcgtccgttacggcgaaacggctgtcctcagtacagcaaccgcttctaaagaaccgaaaaatgtggacttttttccactgaccgtaaattatgaggaacggctatatgctgtcgggaaaattccgggcggctttatcaaaagagaagggcgcccgagcgaaaaagccattttgtcaagtcggctgattgacaggccgatccgcccactctttgccgacggcttccgcaatgaagtgcaggtcgtcagcatggtcatgagcgtcgaccaggactgcacgccggaaatggcagcaatgctcgggtcttcgctcgcactttccgtctccgatattccgtttgaaggcccgattgccggcgtcatcgtcggaagggtggacggcaagttcctcatcaacccgaccgtggaacagatggaaaaaagcgacatccatttaaccgttgccggcacaaaagacgccattaatatggttgaagcgggtgcgaaagaagtgccggaagaagtgatgcttgaagcgatcatgttcgggcatgaggaaatcaagcgcctgattgctttccaggaaaaaattgtggcagaaatcgggaaagagaaaatggctgtcgaattgttcgaacttgacgaagaactggtggaaaaagtcagcggcatgtgccggaaaaaaatgattgaagccatccaggttcatgagaagaaagcgcgcgaagaagcgatcagaaaagtgggcgatgaggtgcttgcccaatttgaagcagaagaagccgatgaagaaacggtcaagcaggttaaacaaattttgcacgatattgaaaaagaagaagtccgcaagctgatcacggtcgataaaattcgcccggacggccgcaaaatcgatgaaatccggccgctttcctccgaagtcggggttttgccgcgcacgcacggttccgggttgtttacccgcgggcaaacacaggctttaagcatttgtacgttaggcgctttaggcgacgtgcaaattttggacgggctcggcattgaagagtcaaaacggtttatgcaccattacaatttcccttcattcagcgtcggggaaaccgggccaatgagagggccgggccgccgcgaaatcgggcacggggcactgggtgaacgtgcgctggaaccggtcattccggatgaaaaagaatttccgtacacgatccggcttgtatccgaggtgctcgaatcgaacggctccacttcacaggcaagcatttgcgcatccacccttgccatgatggatgccggcattccgattaaagcgccggttgctgggattgcgatggggcttgtgaaatccggcgaacattatacgattttaaccgatatccagggcatggaagaccatctcggcgatatggactttaaagtggccggcacgtcgaagggcgtcaccgcgctgcaaatggatattaaaattgcaggactgtcaagggagatactggaagaagcgttgcagcaggcgagaaagggcagaatgcagattctcgaccatatgatgtcgacgatttcgaaaacacgtgaccatttgtccgtctatgcgccgaagattttaacgatgaccattcatccggataaaatccgcgacgtcatcgggccaagcggtaaacaaatcaataaaatcattgacgaaaccggcgtgaaaattgacattgaacaggatggcaccatctttatttcttcgacggacgaagaggcaaacaacaaagcgaagaaattgattgaggatattgtccgggaagtcgaagtcggcaaggtttatctcggtaaagtaaaacggatcgaaaaatttggcgcttttgtggaaatctttaacggcaaagacggccttgtccacatttccgaactcgccgaagaacgcgtccggaaagtcgaagatgttgtcaaaatcggcgatgaaattctggtcaaagtgacggatattgacagccacgggcgcatcaacctttcccgcaaagctgttttaaaggagcagcaaaaaaaagaaaataaatcgtgatgaaagtcagggagccctggctttttttatttgtcccgcgcgcccgttctatgcccctttcccttttcatactttttttaaagaagggggaaaataacgtgaataaagcaaaacgcttgattgcgcttggcttgattgctattctagcattgttgcttgcgggaaatccgctttccacccggtatttgcaggagcgggccgcctttagcacaaaagagaacgagcttcaggaaaaaattgaacaggctgcagaacggttttaccgtccgccggaaaatgccaagattgacagggtttggaaggcgatccccggctataacggggtggaagtggacaaaaaagcttcttactcgaaaatgaaacaggacggccgttacgacgaacgcaaactggtatttaaacaaattccccctgccgtccaccttaaagatctggacccggcccccgtctatacgggaaatccggataaaccaatggttgcttttttaatcaatgtcgcatgggggaatgaatatttgccggatatgctaaaaactttaaaaaagcatcatcttcatgctacctttttcttagaggggcgatgggcaaaagaaaaccctgagcttgcccgcatgattgtaagcggcgggcatgaaaccgggaaccattcctatacccaccccgattttagcactttgccggaatcaaagatcaaaagccagctggtgaagacaaaccgggtgcttgaagcgattacggaagaaaaagtgaagtggtttgccccgccaagcggcagttaccgggatgaagcggtaagcatcgcaaaatcaatgggaatggaaacgatcatgtggacggtcgatacggtcgactggcagaacccctccccggagacgattgtagagcgcgtgactgcgaaagcacagggcggttcgcttattttaatgcatccgaccgcttctacagcgaaagcgttggaaccgttgattgccaggctggaaaagaaaaatttacaagtcggaaccgtttcaaaattgctcgatgaggaaagaatcattaaaaatgaggacggaacatttttaaacagcgaaaaggatcccgctgatacaaaagacggcacagagtgaaatgagactgcgaggaggcacaacatgatacaaaaatatacttgccataacggcttgaggattgtactggaagaaattccaactgtccgttcggttgcgatcggcatttggatcggcaccggttcgagaaatgaaaatgaaaaaaacaatggcatttcccattttcttgagcatatgtttttcaaagggacggaaaaaaggagcgcaaaagacattgccgaggcctttgatgccattggcggccaggtgaatgcttttacgtcgaaagaatatacatgcttttatgcgaaagtgctcgacacgcatgcaccgctcgcgcttgaaattctgtcggacatgtttttccactccactttttcagaagatgaaatggaacgcgaaaaaagcgttgtcaatgaagaaatcaaaatgtatgaagatacgccggacgatattgtccacgatttgcttggcaaggccatttatgaaaaccatccgctcggctatccgattttagggacggaagaaacgcttgcatcgtttacgagcgacgatctccatcaatatgtatatgatatgtatacccctgaccgcgttgtcgtctccgttgccggcaatgtgccgccgtctttcgtaaaggagattgaagcgttgttcggttcctatgaaggcgggaaggaagagacaggcggtgaaacggccgtttttcatacgaatgaccttgcgcgcaaaaaagaaacagaacaggcccatctctgcctcggctttgagggaaagaaaatcggcagtgacgatatttatgagctgattgtcctgaataatatattaggtggcagcatgtcctcccgccttttccaaaatgtacgggaacagcgggggcttgcctattcggtgtattcctaccataccgcctataaggacagcggcattttaacgatttacggcggaacgggcgcctcccaattggacgagctgtttgagacggtgcaggagacgctgcagacgctgaaagcaaaaggggtaacagaaaaagaagtacgaaactgtaaagaacagttaaaagggagcctcatgctcagcttggagagcacgaacagccgcatgagccggaacggaaagaacgaactgttattaaagaagcaccgttcgcttgatgaaatgctcgaggaaatcgaccgtgtcaccgtggaaaaagtcaatgcttgtgcgagggagattttctccaaaccgtattcggcatctttaatcagcccggacggaaaattgccggagcggctgtcttaaagacggcatatcttttccatcccccgcataaaatggaatcagtccatgagagaaagaagggggaatatgcggctcagcgaactcagcggaaaagaaatggtcgattttaaaaaagcggaacggctcggggtattgggcgcaacggaccttgaaattgatgaagcgagcggaaaagtggaggccctgatcatcccggtcggaaggcggtttaaaaaacaagcgaacgagatccgcgtcccgtggaaccggatcagaacgattggtgccgatatgatgattttggaagtgcctgaaaaccagtacagctattaaaaaggcaaagaagcatgccgggtgttccggcatttttctttgccttttttcacaaaaaacatgccgccgccataagatatggggaatcccccatgcacatggaaaagaaggtgaggcatttgttgaccggcgtccaaattgccatcataggcggagatgcgcgccaactggaagtgatccggaaacttgcggatctcgatgcgaaaatttcattgatcggatttgaacagcttgattttgtgtattccggcgtcacgaaagaaaaatttaaagatatccgattttcggaaatggattgcgtcattttgccgattaccgggacagcggacgacgggaaaatcgatttgattttttcaaacgaagaagttgtgctgaccggtgatatgctggctgaaacgccgccttattttacaatctataccggcatcagtaatccttatttggaacaaattgtgaaaaaagcgggccgccgccttgtgaaactattcgaacgggacgatgtggccatctataattcgattccgaccgtcgaaggaacgatcatgatggccatccagaacacggaatttacgattcacggctcaaacgttgccgtcctcggccttggcagggtcggaatgagcgttgcccgtgctttccactatctcggtgcgaaggtgaaagtcggcgcgagaaaaagcgaacatcttgcgaggataacggagatggggcttgcgccttttcatttaaacgatcttgaacaggaagtaaaagacattgacatctgcattaatacggttccacacttgatcgtcaatgcatccgttatccaaaagatgccttcgcatacgctcattctggatattgcctccaaaccgggcgggacggatttccgctatgccgaaaagcgcggcattaaagcgatgctggcaccgagcctgcccggcattgtcgcgccaaaaacagctgggcggatactcgggaatgtgctcggccggctgattgaagaagacgttttaaaaagaaaggggtcatcgccatggatgtaaagggtaaaagaatcggcttcggcttaaccggctcccattgcacttacgcggctgtttttcctgaaattgaaaagctcgtggcatcgggagcagaagtcatcccggttgtcacgcacacggtgaaaacgacggatacaagattcggcaaaggctcggaatgggtggagaaaatcgaaaaatgcaccgggcaaaaagcgattgattcgattgttgaagccgagccgctcgggccaaccttgccgcttgactgcatggtgattgcgcccctgaccggatttacgatgagcaagctagctaatgcactcactgattccccagtgctaatggcggcaaaagcgacgctccgcaatttgaaaccggttgtgctcggcatttcgaccaatgatgcgctcggattaaacggcgtgaatttgatgcggctgatggcaacgaaaaacatctattttattccgtacgggcaggacgacccggtcaacaaaccgaattcaatggtggcgagaatgactgcccttgtcgatacggtttcgcttgcactcgaggggaaacaaatccagcctgtcattgtcgaacgtttccgcaacggaaaatcaaattgaaaccgatttaaaattaaaaaaatacacacggtgccggaagacttgtgatacaataatagctataaaaatgaatttggttttggaattggaaggggaatacgccaatggcaaacacatcaggttatcacgtagctgttgtcggggcaaccggcgctgtcggccagcaaatgattaaaactttggtaaaccgcaaatttccgtataacaaattgacgctgctgtcatcttcgcgttccgccggcaaaaaaataacggtaaacggggaagaaattacggtccaagaagcggtgccggaaagctttgaaggagtggatatcgcccttttcagcgcaggcgggagcgtgtcgaaaaagtttgcgccggaagcggtgaaacgcggggcaattgtcattgacaatacgagcgccttccgcatggacccagaagtgccgcttgtggtcccggaagtaaacgaagaagacattcaaaaacataacggcatcatcgccaatccgaactgctcgacgatccagatggttgttgcgttggaacccgtccgcaaaaatttcggcctgaagcgggtgctcgtttccacgtaccaggctgtctccggttcgggcgcggctgccatccaggagctgaacgacgagacgaaggcgttgcttgaagggcagacttacgagccgcatgtactgccggtaaaaggtgacaaaaagcattaccagattgcgtttaatgccatcccgcaaatcgatgtgtttacggacaacggctttacatttgaagaaatgaaaatgatcaacgaaacgaaaaaaatcatgcatatgccggaattaaaagtttccgccacatgcgttcggattccggttgcaaccggccactcggaatcggtttattttgaaaccgaaaaggacggcataaatgctgggcagatccgggaagtgctcgcgtctgcacctggtgttgtactggaagaccgccccgaagaacagatttacccgatggccgtcaatgcggtcggcaagtatgacacatttgtcgggcggatccgcaaagacccggatgaagacaacggattccatatgtgggttgtttccgacaatttgctgaaaggcgctgcctcaaattccatccagattgcggaaagcctgatcaggatggggctcatctgatttgtggacaatttaggctgacctttttgcaatattggtgataagatatagggaaagaaaagttatgccggaatccggtatcggagagggttccatttcctgatatattttatggacacgtatgccgtttcctttccggccgggaaggaaacggtttaaaaacggccggcccttaaaacggcctttgacaaaaaaacggccggcaaagcccgcacgttaccggaatcactgttcttatttatcagttcataacagaggtgttcttcattgaaaatcgttgtccaaaaattcggcggcacatccgtacgggatcatgatgcaagaatgcatgccaaacatcatgtagaaaaagcgctggaagaaggctataaggtggttgccgtcgtttcggcgatgggtcgcaaaggggaaccgtatgcaacagatacgctcctgtcactcgttggcggatccgacacctgtttaagcaggcgtgagcaggatttactgttgtcaaccggcgaaatcatctccagccttgtgtttgccaatatgttaaacgcacacggcatcagtgcgtgtgccctgaccggtgcgcaagccggtttccacacgaacgcggagcataccaatgcgaaaatcacggacatgaagtgcgaccgtgtcctgcgtgaactgaaactgcacgatgttgtcgtcgttgcaggatttcaaggagccgcaaaaaacggggacgtcaccacgctcggacgcgggggcagtgacacatccgctgcggcgctcggtgctgcgcttcaggcggagtggattgatatttttaccgatgtggaaggcatcatgacagctgacccgcggattgctgaaaatgcgcggaagcttcaggttgtcacgtataacgaggtctgcaatatggcttaccagggcgcaaaagtgatccatccgcgcgccgttgaaatcgcgatgcagtcgaaagtgccgatccgcatccggtccacttattccgacgatatcggtacgcttgtcacatctttaagccaccgtcagaaactcgggaccgatataaaagaacgcactgttaccggaattgcgcatgtaccgaatgtttcacagatcaaagtatatgcaaaagacgggcagtatgatttgcagacggttgtgtttaaagcgatggctgctgaaaatatcagtgtcgattttatcaatatttccccgacaagcgttgtctacacggtttcaggagaggtggcaaaccgggctgaagcggtgctgaaaaaactggggcatgaaccggtaattgaacggaactgcgccaaagtatcgattgtcggcgccgggattgcgggcgtgccgggtatcacgtataaaatcgtgtcggcgctttccgaaaaagggatccggattttacagtctgctgacagccatacaaccatctgggtgctggtgaagcaggaagatctggttacagcggtcaatgcccttcatgatgcctttaatttagaaagcgaaacggaaacgtatgaaattcatgcgtaaaaaatgaaagattttctgccgggtgttttcaccttgcaacttgcaaaacctggcaggatgaggagtgtaagtatgagtcgtttcggaaaagtttcaacggcaatggtgacgccttttgaccataaagggaatctggatttgcaaaaggcggcaaagctggttgattatttaattgaaaacggaacagaatctttggttgttgcgggaacaacgggggaatccccgacactttcgcctgaggaaaaaactgcgctgttcaagcaggttgtgaaaacgtcagacgggcgggtgccggtcattgccggaacagggagcaacaatacgtatgcttcgatcgaattgacgaagcgtgcggaatcatgcggcgttgatgccgtcatggctgttggcccgtattataacaaaccgaaccaggccggcatgtatgcccatttcaaagcgattgcggaatccaccagcctcccggttgtcatttacaatatccctggccggtcggctgtcaatattgaaccggaaacgatcatcgaactttccaaaatcccgaatatcgttgcagtaaaagaagcaagcgggaatttggatgcgatggcgcaaattattgcccgtacgccggatgattttgaattgtacagcggggatgacggcctgacaattcccgtgctttcaatcggcggggcgggtgtgatttcggttgcttcccatgttgccggcccggccctacaggaaatggtgcaagccttttttgccggggatgtaacaaaagcggcaaaactgcatcaaaagctgcttccattgatgcgcggcctgtttatggcgcctaatccggcaccggtcaaaaccgctttgcaattaaaagggatggatgtcggcggcgtccgcctcccgctcgttccgttaacaaaagaagaacgggaaaacattcaccgcctgcttggcgatctttaagcaaaaaaacggcccttccggaaaaacggacagggccgttttcttttgcttaagtgatcccataccggcttcgggaaaggaaaacaggccccgtttccgctaatcttccggcaaacagcagattagcggaaatgggcagcatttgtcgatagaaatatcacacgctcttcattgaccggatatacccttttcggttaagctatacataagagaaaggatcggacagcaatttatttttacgggctcagaaagtctttttcgatagaaccggaacggtgcaagtgatcgtgcgggcgcctcatgccaggtatgacgtttttaaagggatgcggcgggagagccggccgcttatttttatgccggaaacttgaatatgcgcaaagccgtatcggacggaatccggcaaccctttgcgatctatcaaaaagaaacgtgattcctgctctagaatttcagacaacacgggaggaaaagaattttgcgtaaggaaaaaaacgaaaccattaaggtcattcctttaggaggaattggtgaaatcggaaagaatatgtacgtggtggaaaccggagaggatctgtttgtgctcgatgccgggctgatgctaccggaagacgaaatgctcgggatcgatatcgtcatcccggattttacttatttaatggaaaacaggcagcggataaaagggattttcctgacacacgggcatgaggatgcgattggtgccctgccgtatatcctgatgaaattgaacgtgccggtgtatgccacaaagtttaccgtcgcgctggcgaaagaaaaattgaaggaactaaaagtgaaaaagcatatccgctttacggaaatcgacgctgacacagttctccattttgaggcttgcgatattcgctttttcaaaacaacgcacagcattcccgactcggtcggcatttgcatttccacatcgaaaggcaatattgtgtataccggcgattttaaatttgaccaggaactgggcgggcattatcgttcagaaatcggaaaaatgtcgaaaatcggtgaagaaggcgtgctgctgttactatccgacagcacggaagcggaacatccaggctacacgacccatgagtctgttgtggcggaagaaataacggatgctttctacgatgcgaagggccggattattatcgcaagctttgcctcgaatttaatcagggtgcagcaagtgctcgatgcggcttctgctaccggccgcaaagttgcgtttgtcggaaattatcttgaaaaaatatataaaattgcattaaaattgggatacttgcaggctcggacagaggatctcatcatcccgctgcaacaaatttcaaaataccgggacgaagaactggcgattttgacaacagggagccagggggaaccgtttctcgtcctccagaaaatggcgaaaaagaaccataagcaggtcaatattcaaaaaggggatacggttatccttgccacaacgccgtctccggggctggaactgttcatggcgaaaacgatcgacatgctgtaccgtgcaggagccgatgtttacgcgggcgaccggaaaattcatgtgaccggccacggctgccaggaagatttaaagctgatgcttgatttaatgaggcctaaatactttgtcccgatccagggggaatacaggagcctgtatgcccatgcaaaactggcgtacaaaacggggatgccgaaagagtcagtcatcatctccagcaacggggaagtattggaatacaagcacggcaaattccaagcgagcagccgggttgcttccggcaatattctcattgacggaatcggcgttggcgatgtcggcaatattgtattgcgggatcgaaaacttttaagccaggacgggatattggttgtcgtcgtcacgcttgataaaaagcataaaaaactggctgctggccctgaaattatctcgcgcgggttcgtctatgtacgcgaatccgaaaagctgatcagccattcgtccaacatcgtaaaagaagtggtggagcagaacacgtcacaggaagcttttgactggacgagtattaaacaggggatccgcgaccatctcagctcctttttatatgagcagacgaaaaggcgcccgatgatcctgccaattattatggaagtttgatgcttaaacgacagagggcggggcgggggttcccgcgtgcccgcgctcattgcggcacaaggcccgcctggtgcaccattaaaaatgcaaagcaaagccccgcttccggttccggaaaccgcggggcttccgtatgaaaaccccttccatgcaaataataaggcgtaaaggcgtcacgcccttacattacaggcaaaaaggggttttagaaaaatgagcgaccagcaaccgaataaagaagaaccgaaagaaggaaatgcggcatccgcgcttgtagagaaaatccagcagctcggccagacaaatgtgccgcagctcgggcaggactccaatatccactgcctggccatcgtcggccagattgaaggacatctgcagctgccgccccaaaataaaacgacaaagtatgagcatatgatcccccagcttgtagcgattgaacaaaatccgaaaattgaaggggtgctcgtcattctgaacacggtcggaggggacgtggaggccgggcttgccatttccgaaatgcttgcttccctttccaaacccactgtttcgattgtgctcggcggggggcattccatcggcgtgccgatcgctgtatcctgttcgtattcctttattgctgaaaccgcgacgatgacgattcatccgatccggctcacaggccttgtcattggcgtcccgcaaacgtttgaatatctggataaaatgcaggaacgggtgatcaagtttgtgacgcggcattcgcatgtggaagaagaggtttttaaagacttaatgtttgcgaaagggaatttgacaagggatatcggcaccaatattgtcggtcaggaagccgtccagtacggtttgattgatgaagtgggcgggattggcaaagcgcttggcaaattaaacagcctcattgaaaaataccgggatgaaaaagggaaagaggggctgatccaatgattctctatacgatgatgccgcaggagttgatttttcctgaagatgcaaacgcctggaataaaattgaaatgttaaacgtaaaaggcgtgccggtactggcagagcagcttgatgaaggataccggattacccgcattctcagctccaatcctttcgactatctgaatccggagcttgcacccggaaatgtgatccgccatttcggaccgtaaaccacccgggccgcaaatatgctataatatgttaaaacaagcagccacacaggctgctttcttgcatcccgttccggcaggcaagactgaaaaatacgttttcactatcgaaggtggttatatggcgaaaaaaaagcggcgcagaagaaaaaaagctgctgaacaaatcaagatagatttaaagtttgagttgctcggtattatcctgcttacgctcggcatttttaccctttaccatattggcaaaacgggcacaaccctgattctgttcttccggtttttcttcggccggctgtactgggttgcggttgcctctctggtcgtgctcagcgtttttctcatgattaaacgggcatggcctgcatttttcactatccgcatgaccggattttatcttttatttgcgagcgccctcctttactgccatgagcggcttatcgggtcattggcaaatgcgcatgaattgtccggcaacagcgcggtcgaaaatacgatcaggatctggcatcaggaagagcagatctggtggaagcttgtgctcggcggggatgtgcacggcaatattttcagtacgcagatcggcggcggcatggcaggtgccattttatatgcggcctcccatttcttatttgactcggtgggtacgaaaatcatttgcgttttactcgcgctcatcgctctgatgcttttaacgggcaagcctataagcccgtatgtggaaaaggcattggaagggctctggctgtttttaaaaaagcaatggaaccagatgaaaacagaattccaggcatggcgggaagccaaaaaagaaaaacaggaaaagaaacggcagaaagcgccgtcgcagccgcaatccgcctccgcagacggggaagtcagcgacggggatgccggaccggcaggcgaggaaacgcctcccccgattatttccagctttacggagcagtatgccggcacggctccgcaagcggaagaagcgcagccggaaacgccggatacagaagcggaagaggaccatacgcctccgattcagtttacggagtatgaaaatgaagactatcaattgccacccctgacgctgttaaataggccgcgggcagcggaccagagcagcgaatataaagcgatccatgccaatgcggcaaaacttgaacggactttccaaagcttcggggtcaaggcgcgtgtaacacaggtgcatttagggcctgccgttacaaaatacgaagtgcaccctgatgtcggcgtgaaagtcagcaagattgtcagtttaagtgacgacattgcccttgcgctggcggcgaaagatattcggatggaagcgccgatcccgggaaaatcagcgatcggcatcgaagtcccgaataaggaaatcgcggtcgtatcgctcagggaagtgcttgaaggaaaggaaaataacccgcaggcaaaactgcagatcgggctgggccgggatattacagggcaggcggtactcgcagagctgaataaaatgcctcacctgcttgtggccggcgcaacggggagcgggaaaagcgtgtgcattaacgggatcattacgagcatcttaatgcgcgccaaaccgcatgaagtgaaaatgatgatgattgacccgaaaatggtcgaattgaatgtttataacggtgtcccgcatttgcttgcaccggttgtgaccaatccgaaaaaagcttcccaggcgctgaaaaaagtcgtgaatgagatggagcggaggtatgagcttttttcccataccggcacacgcaacatcgaaggatacaacgatcatattaaaaaaagcaacatcgaaacaggggacaagcagccgcttttgccttatatcgttgtcattatcgatgagcttgccgatttaatgatggtggcaagcggcgatgtggaagattccattacgcggctgtcgcaaatggcgcgggcggcaggtattcatctgattattgccacgcaacggccgtctgttgatgtcattaccggtgtcattaaagcgaacatcccgtcaagaatcgcttttgccgtgtcttcggcgactgactcgagaacgattttggatacgggtggcgcggaaaaactgcttggccgcggggacatgctgtttttgccggttggggcttccaaaccggtacgcgtccagggcgcttatctttccgatgaagaagttgaagaagttgttgatttcgtcatttcccagcaaaaagcacagtaccaggaagagatgattccggaagagcctcaggaccagccggatttcgacgatgaattatatgatgaagcggttctcttaatctcggaaatgcagaccgcttccgtctccatgttgcagcgccgtttccggattggctatacaagggcggcgcggctgattgatgcaatggaggcaagaggggttgtcgggccgtatgaaggcagcaagccgcgtgcggttttaatcccgaaaccttcagaagaacagagctcatagcacgccaaagaaaaaacctgcgcgcaccttagcggccacaaaacgccgcggtgcgcgcaggttttactattttcgacaaaaatataaatttatgtttctttcgcaattaaaaaatgatatatttatgtcggtaagcaggataataggctgtttctaaagactgttatccaaaaataactttcccggggggaacaaaagtgaaaaaacgtaaatttggtttggctcttgccgctgtcctggcagcagggacgcttctcggcgcatgcggcacaaagagcgacaattccgcaagcaaaggtaaggacaagttcaccgttgcactcgtaaccgatacgggcggaattgacgatcgttcttttaaccagtcggcatgggaaggcttacagcagttcgggaaggacaatcacttatcaaaaggtaaaggcggctttgactatttgcaatccaaatcggatgcagattacacaacaaatctgaacacggccgtccggaaccagtttgacctcgtttacggcgtcggctataagctgaagccggccattgaaaaaattgcggatcagcgtaaaaataccaatttcgcaatcattgacgatgtcattaccggaaagaaaaatgtggcaagcattacgtttaaagaacaagaaggttccttccttgtcggggtcgtggcaggcctggcgacaaaaaccaataaaatcggatttatcggcgggacagacagcgatttgatcaacaaattcgcagccgggttccgtgcgggcgtcaaagctgccaatccgaaagcaaatgtgcaaattcaatatgtcggctcgtttgatgatgcaagcaaaggacagtcgatggcttcagcaatgtataaatctggcatcgacgtgatttaccatgcagccggtggcagcgggaaaggcgtctttacagaagcgaaaaatataaaacagaatgatccgaacaaaaacgtctgggtgatcggtgtggaccgcgaccaggcagatgaaggaaaggtaacggttaaaggaaaggaatacaatgtgacactgacttcaatggtcaaacgggttgataaggcagtcatcgatttatcgaccagagcgaaagacggcaaatttccgggcgggaaaaatattgtttacggcttgaaagaagatgccatcgggattgcgccgacacaggacaatttaacgcctgaaatgaaatcggccgtgaaagactggaaacaaaagatcattaacgggaaagtgaacattccatcaaaattgaagtaatcgatccatctcacgggactggtttttgccggtcccgtgttaaaaatgtttaaaaaatgaaacaatttcagccaaaaaggcagggcggattccccgaagctgctgtctaaagacgccatgacgattgctttctttataccccaatgttaaggagtgataaagggtggactacgtaattgaaatgctccatattcgcaaagaatttccgggaattgttgcgaacgatgacatcaccctgcaggtaaaaaaaggagaaatccacgcgctgcttggagaaaacggcgccggaaagtcgacgttaatgaatgtacttttcgggttgtatcagccggaaaagggagaaatccgtgtaaacggccagaaagtgaacattaccgatccgaatgtcgcaaatgatctcggcatcggcatggttcatcagcattttatgctcattgataagtttacggtgactgaaaatattatcctcggcaaggaaccgaaaaaatcctttaccatcgatatcaaaaaagcggaacagcaagtccgggaaatttccgaccgttacgggctggatgtggatccgcaagcgaaaatttcagatatttccgtcggtatgcagcagcgggtggaaattttaaaaacgctgtaccggggcgcagaaatccttatttttgacgaaccaacggccgtgcttacgccacaggagatccatgaactgatcggcatcatgaagacgctgatccaggaaggaaaatccatcattttaattacccacaaattgaaagaaattatggaagtatgcgacagggttaccgtcatccgcaaagggaagggcatcgggacgctcaatgtccaagatacaaacccgcaggagctcgcccatttaatggtcgggcgagatgtccttttcaagacggaaaaaacggagggccgcccgggacaaaatgtgcttgaaatcgagcaattgcatgtgaaagattcacgcggggtggaagcggtcagagggctggatttaacggtcagggccggcgaaattgtcggtattgccggtgtggacggtaacgggcagtcagagctgattgaagcgattacagggctcagaaaagcagacagcggcacggtccgcctgaacggtaaaaacattacgaacttaaggccgcgcaaagtaacggaagcgggcgtctcccatattcccgaggacaggcataaatacgggcttgtactcgattatacgatcggggaaaacatggtgctgcaaacgtattacaaaaacccaatgtcccgtaacggtatcttaaattacaaagaaatttataaaaaggcaaaatcgattattgcagaattcgatgtccgtaccccaagcgaatttacaaaagcgcgggcgctctcagggggaaaccagcagaaagcgatcatcgggcgtgaagtggaccgcgatccggaccttttgattgcggcacagccgacccgcgggcttgatgtcggggcaattgagtttatccacaggcggctgattgaacagcgagaccacggaaaggctgtcctgcttgtatcgtttgaactggatgaaattatgaacttaagtgaccggattgccgtcatctacgaaggagccatcattgatattgtcgatccgaagcagacgacagaacaggagctcgggctcttgatggccggttccaaaaaagaaagggaaggtgaacaaaccaatgtctaaccgaacattgaaccttctgatccctgtcgtgtctgtcattctcggacttttggcaggcgcattgattatgcttgtcagcggctataacccggtggatggatatattgcactctggaacggcgctttcggccaggctttttacgtcggcgaaacgctgcggcttgcaacgccttatatttttgcggggcttgccattgcctttgcgttccggaccgggctgtttaatatcggggctgaaggccagctgatcgtcgggtggattgcggctgtctgggtcggcgttgcttttgatctgccaaaagtgatccacttgccgctcgcgatacttgccgcctgctgcgccggggcattttggggattcattcccggccttttgaaagcgcggctcagggtgcacgaagtgattgtgaccattatgatgaattatattgcgctgcacacatccaactatttaatccggaatgtgctttcaaaacagcaggatacgacaccgcatattcatcattcggcatcgctttcgtctccgttttttcagaagattactgacttttccactttgcacaatggcatttacctttctttggttgctgttgtggtgatgtggtttatcattgaaaagaccacgctcggctttgaactgaaatcggtcgggtttaaccagagcgcatccgaatacgctggcatgagtgtgaatcgcagcattatcctttctatggtcatctccggtgcttttgccgggctcggcggcgcaatggaagggctcgggaattacggctttgcctttttgcaatctaacttctccggcatcgggtttgacggtattgcagtggcgctgctcggcgggaatacagcgcccggcgttttaatcgcagctgttttattcggcgctttaaaagtcggctcgctgaacatgccggtcgatgccaacgtgccgaatgagctggtcaacattgtcattgctttgattattctttttgtcgcatccggctatatcatcaaatggtccctggcccgtttgaaaagggaggcgaaataaaatgcattttatgaccgctttggaaatcattatttcggcgtctttactatctgcagcaccgcttatttttactgctttggggggcgttttctccgaacgttccggcgtggtgaacatcggccttgaagggttaatgatcatgggggcttttatatcgattgtctttaatttaacgttttctcatgccctgggcgcctggacgccgtggatcgcggtgctggtggcgatgcttgtcggcggattatttgccttgatccatgcggctgcatccatttctttccgcgccgaccagacagtcagcggcgttgcgattaacttccttgcgctcggcgtcgcgatgtttctcatcaaaaacatttacgggaaaggccagaccaatacgatcagcgaatatttccagcaggtggatgttcccggcctcagccatattcccgggatcggcaaactgtttttccaggggattacatacccttcttacattgccatcctgattgcgattctcgtctggtttatcctttacaaaacgccgttcggcctacgcctccgttcggtcggggaacatccgatggcggccgatacgatgggcatcaatgttgtaaaaatgcgctactttgccgtctttttatccggtgtattcggcggaatcggcggggccgtgtacgcacagtcgatcaccctgaatttcagttcttcgacgatttcagggcaagggtatatggcgctggctgcgatgattttcggcaaatggaatccgctcggcgcgatgggggccgctttatttttcggatttgcacagagcctcagcatcgttggcaacagcattccgtatttgaaagaaatcccgagcgtttatttgctcattgcgccgtatgtcctgaccattctggcactcgccggattcatcgggcgtgcggaagccccgaaagcagacggcgtcccttatatcaagggtgaacgctaggttattccatccggcatcaggctgcttttcccgcctggtgccggtttctttatgtgccgtaaaacttgccgggacacctgtctcccttgtatagtaaaattaatgcatttacaggttaaacaaccccctagtcaggcatacttttactattgcacgaagctcgttgaaaaaggaggatccatatggccatttcaaaagagacggttcgcaaaatgaaagggtacacactacataccatcaaaacggacaaatacaaaacgaatacgcttgtatggaaaatgaaagcaccgcttgaaaaagacacggttacgctgcgggccctgctcccgaatgtgcttcaaagcagcacgaagcgtttgaatacgaccgcaaaattaagggcgtatctcgatgatttgtacggcgctcatttttatgtcgatacggccaaaaaaggggaataccatattctaacctttacgattgaaattgcgaacgaaaagtttttgcaggatgcagaaccgctgctccaacggggggttgaatttttggcggaagttttgctgaacccgcatgcagacggcgggcagtttgacagccaaacggtggaaaaggaaaaacgggtgctgaaacagcggatccagtctgtatacgatgataaaatgcggtatgcaagcatgcggctgattgaagaaatgtgcaaaggagagccgtacgcactgcaggtaaacggtgttcttgatgatgtggacgccatcacgcctgccgatctttatcaatattatcaaaaagccatccgggaagatgaactggacttatttgtgacaggtgatgtcgatgaagaccggcttgcggccatttgcgaatgcctgcgttttccggaccgcgagccgacacgcgctgccgcaagaacgcttcaaaaggtctccagcgtcaaaaaaatcaaagaatcgcaggatatccgccagggcaagctgaatatcggctaccgcaccaatattacgttcggagacagcgattattttccgctccagatgtttaacggcattttcggcggtttttcccactccaagcttttcctgaatgtacgggagaaagaaagcctttgctattatgtcgcgagccagatcgagagccataaagggctcatgatggtgatgagcggcatcgaatccgcgaattttgacaaggccgtctccattattgaaaaacagctggaagcaatgaaaaacggcgatttcagtgagcaggaaatcgggcaaacgaaagccgttatccgcaaccagctgcttgagtcaacggatacatcccgcggcctcgttgaaattttgtaccataacgtcattgccggcaccaagaccggcgtggaagactggataagggaaatcaaggcagtcggaaaaggggagattgtgaaagtggcggcaaaaattgaacccgatacgatctacttcttgtccggaatggaggggaaataaatggaaacccaacaattcagccagcttggcgaaacgctttacggtgaaacacttgataacggattaaaagtctatgtgctcccgaagcgcgggtttaacaaaacatttgtcacgtttacgacaaaatacggttctgttgacaacacgtttgtcccgcttggaaaaagcgattttgtgcgggtcccggacggcattgcccattttctcgaacataaaatgtttgaaaaagaagacggggatgtgtttcagcaattcagccggcagggcgcatccgccaatgcttttacaagttttaaccggacggcctatctgttttcaagcaccgatcaggtgatgaaaaacctggaaacgctggtcgatatggtgcaaacgccgtattttaccgcacagacggttgaaaaagaaaagggaattatcggccaggaaatcatgatgtacaatgacaacccggactggcggctgtattacggcctgattgaaaatttatatgcaaaccacccggtaaaaattgacattgccggcacggttgactcgatcgcaaaaatcaccgcggagcaattgtacgagtgttaccatacattttatcatccgagcaatatgctgctgtttgccgtcggaaatgtatcgccggatgaggttctttcttttatgagagaaaaccaggcgaagaaaaagtacgaaaaagcaccggagattaaaaggcgttttccggaagaaccagcacaggcggccgaaaaagagcagaaattgcatatgaatgtgcagattccaaaatgccttgttggcgttaaggcgcttcatacgagccagcgcggcgctgaaatgcaaaagaacgaacttgtggtcaatcttctccttgacatgctgttcgggcgcagttcagatgcgtacaatgcgttgtacaatgacggcctgatcgacaccagtttttcttttgactattcccaggagcagggatttggatttgcgatggccggaggggatacgaaagatccggaccttttggcaaaacggctgaaagaggtgatgattgcggcaaaagaaggaaaaggtttggcggaagaagcgcttgaacggacgaaaaagaaaaaaattgggggattcctgcgccagctgaattcacctgaatttatcgccaaccagtttacaagatatgcgtttaatgatatgaatttatttgacgtcgtccctgcgcttgaacaaatccggttcagtgatgtgctggaaacggcggaagctttttttgaagaagaacggtttaccgtttgccaagttttaccgaaataacccgggactctcccgggtttttaagtgggggagaaaattgaaaaagtttgcgttgattacgggtgcgagtggcggcatcgggaaggcaacagctgaaatgctggcaaaagaaggatggaatttgtatttgcattaccatcaaaatgaagcggccatcaaagaactgctttccatttgccggcatttcggggcggaagcgatcccgatccgcgccgatcttgcaacggacggcaccgtaaaaacgattgcagaaaatgtttttcatctcgatgcgatcatccatgcggccggcatttcccactacgggctgctttcggatatcgatgaggcagccattgacaagctttaccggattcatgtgaaggcgccgcttctgatcatcaggcagctgttgcccaaattgcggcaaaatgcggtttcacacattgtgcttgtcagttcaatctggggacaggcaggcgcggcgtgcgaagccgtatattcggcgatgaaaggcgcacagatcgcatttgtaaaagcgctcgccaaagaaacggcaagaagcggcgtacgggtgaatgcggtcgcgcccggggcggttggcaccaatatgctttcaaggtttgcgccggaagaaatttcggatctcgaagcggacatcccgctcggccggcttgccaaaccggaagaaattgccggcgcggtttctttcctgctctcggaaaaaagcaattacatcaccggccagacgattggcgtcaatgggggctggtatatgtagtcccgcctggagaaagttgcaaaggaatcctctttgttttttcgcggattaaccaaaaaagggcaacagcacaccgttttgcccggctggtgccttgaaagaagcacgggttccattttccatgcatagccttccacgccgggtcacaaactaaggttgaacaacttgaaaggaggctgtgacatgaacgtattcgaaaactgggaccaatggaaaaactttttgggggaccgcctcaaccaggcaaagcaacaggggatgccccaggaaacgattaacaaacttgctgagcaggtcggcgattatttggccgcacaagtagatccgaaaaatgaacaggaacgcgttcttgctgacttatggtcagtggcatcgcaggaagaacagcaagccattgccaatgtaatggtaaaactcgttcaaaataacggtacccagtcataaagaaataccggcgcatcatgataacaattggctgcttttttacaagaaaagccggttgtttggctgatgccgccggttttttcatgtcacgacaaaattcacgatttttagagctttcgcttccttattgatgtaaaatcatatatcatataacctagatatgttcgtttggatccggatttcgggaggggttatgggtggatgacaggaaagagtggtacttggaatatgaaatcacgatcaaccggccggggctgttgggtgatatttcctctctcttgggcatgttagcgatcaatatcagaagcattaacggcgttgaccataaaaaacgaggcctgctgctgtttgtcaaaaatgaagaacagatcggccggctcgaatcgatattgcgaacagtggaaacgataaaagtaacgaaaatcagggaatccaagctcagagacaggcttgcagtccggcacggaaggtatattcagcgcgatcatgacgaccggaaaacattccgttttgtgcgcgatgatctcgggattctggtcgattttatggccgagcattttaaacaggaaggccataagctgattggcattcgcgggatgccgcgcgtcggaaaaacagaatcgattgtggctgcaagcgtgtgcgccaataaaaagtggatttttctctcctccacgatgatcaagcagacggtgagaagcagcttgattgaggatgaatacaatgcaaacaatatttttatcctggatggtgtcgtatccgccgagaggggaaacgaacggcactggcagctgatccgtgaaatcatgcggctcccggctgttaaagtggtggaacacccggatattttcgtgcagcgttcggaatacacgctcgatgactttgactacattattgagttgagagaagacccgtcacaagaaattacatacgacttgctccagcaaaaccggatgtttcaaggcgaatttggaggatttgattactagattggcaggtgttaccatgacggaattagggaatcgtttaaaagaagcaaggaaagaaaagggcatcagcctggatgatttgcaggagatgaccaagatccaaaaaagatatttaaaaaacattgaagaaggaaattatgattcaatgcctggaaaattttacgtccgggcatttattaagcagtatgccgaggcagtcgggcttgatccggaaactttatttgaagagtaccagagtgacatcccccgtacggaacaggaagaatttcccgagcaactttcgcgggtgcagacgtcctccaaaagggccgcaccggataccttcaagatgatgaacgtgctgccaaggatccttgtggtcgccgccatcatcgcgattttatttttgctttggtttgttgtatataagcttgccggccacaacacaaaggaaaaattaaacagcgggacttccggcaatgtgagcgtacaaaaagataacgtcaaatcggctgaaaaggtgtcatccggcaaaaacaccggcagctcttccgaaaaaaatgcggcgaaagcgccaaaaaaaccggaagcgaaaacgaagaaaacaacccaaaaactggaaaccgtatcttcaagcgggtacacgaccacctataaactggccggcaccaaccagttcaaacttgaactgaaagcaaacggcggacggtcatgggtacaggtgaaaaacagcgacggttcaacgaactttcaacaattgctgaatgacggggacagccggacagcggatctgtcaaaacaaaaacaagtcacgatcacggtcggaaacaccgtcaatacggaagtgtatatcaatggcaaaaaactaaaatacaatattccggcatccaaagaagtacgccaggatatgatcgtccagtttaacgggtcacaaacgaaataagccttgttttaaggctttttctttggaaaatatatagacagttggaggaaaagccagtgaatttgccgaataaaattactgtatcacgtgtatgtttaatccctgtttttttactcatcatggcggtgccgttcgattggggcacctttgaatggctgggagccaaaattccggtcacccattttgtcggtgcggtgatttttgccattgcctctatgacagactggatcgacggccactatgcccgcaaatacaatctcgttaccaacttcgggaaatttctcgatccgcttgcggacaaactgcttgtttcaacggcgtttattttgctcgttgggctcaagctggcgccggcatggattgttgtcgtaatcattgcccgcgagtttgccgtgacaggcttgcgactgattttagcagagggcggggaagtagcagcagccaatatgcttgggaaaatcaaaacatggacgcaaatcattgccatccttttattgctgttgcataactttccgttttcggcgctctcttttcgcttggatctgatcgctttgtgggtagcgctcatctttaccatctggtcaggcgctgattatttctatttaaaccggggcgtatttgcccgctcgaaataaccatgcagtgaaaggcagcctttcactgcttttttgcccgccagtggcttgtgctaatccggcacgggagaaaaaggcagccattgcttcgggtggattggcggcctggattgcgccgtcatgtgttcgtttttttgctttaaaagaaagggaggaatggaaagtgaatgccgaaattattgcagtcggttcggaacttttgcttggccagatcaccaatacaaatgccacatttattgccgcacaattggcggagatcggcgtggatgtgtactaccagaccgttgtcggcgataacgcagagcggctcgaagcggcaatccggacagcggagggccgcgccgatctattgatttttactggtgggctcggtccgacaaaggatgatttaacaaaagaaacgattgcatcgcacatcgaaaaaaaactggtgacaaacgaagatgccatgcgctccatcgaacagttttttatccgtacaaaacgaaaaatgacggaaaacaacaaaaagcaggcactggtcatcgaaggttcaaaagtgtttccgaatgaccacggtatggcgccgggcatgctggccaaaagcggaaaccattattatatgctgctgcccggcccgccgcatgaactggaaccgatgtttatccattacgccagccccgcaatccaggaagaactggaaacgatcgaaaaaatcgaatcgcgcgttctccgcttcttcgggatcggcgaatcccagctggaaacagaaatccgccatatattggatagccaaaccaatccgactgtcgctccgcttgcgaaagaaggggaagtgacacttaggattacggcgaaacaccagtcggcggaaacggcgaacgaaatgatcgatcaagtggaaaaagagattatgcaaattgccggatcgtatttttacggttataatgatatgacattaatggaggccctgctcgaaaagctttcgaaaaaacagctgacgcttgcctgcgcggaaagcctgactgccggcaaatttgcagcggaaatggcgtccatccagggtgtcagcacaatgttgaaaggcggcgttgtcgtctattcaaacgaagcgaagatgaagctcgccaaagtgaaaaaagaaacgcttgacaagtacggcgccgtcagcagccagtgtgcaaaagaactggcggaaaatatccgtagcattatggatgccgacattggcatcagttttacaggcgtggctggcccggactcccttgaaggccatccgccgggaaccgtgtggatcggcattgcgataaaagggaaagaaactgccacttatctgttggaacttcccggatcccgcaacaacgtccgcacgcgatcggtgaaatacggctgctggcatttgctgaaactgctttaggtcgaaagccgcttctgctcatggcaagtgacggaagcggcctttttataaaaaaatttgtttgccaaaaattcaattttcggctctttttgccgggggaattttcatttttacaaggggaaaaccccatttttttgccggatttttgcaaaaaagagacgaatgagcgttcgagattttgcttggcaaacagagaaaaaacgggtatagtatagatatagattcattgctttcgagagtttggaatgaataaaaggaggaaattttgtgaatgatcgtcaagaagccttagacaaggctctgaaacaaatagaaaagcaatttggtaagggttccattatgcggttgggcgagcagaccgaccgggttgtctccacgatcccgaccggttcgcttgcgcttgatattgcccttggtgtcggcggttacccgcgcggccgcgtcattgaaatatacggccctgaaagttctggtaaaacaacggttgccctgcatgcgattgcggaagtccaggcacagggtggacaagcggcgtttattgatgcggaacatgcacttgacccggtttatgcccaaaagctcggtgtcaatattgatgagctgctcctgtcccagccggatacgggcgaacaggcgctggaaattgcggaagcgctcgtccgcagcggcgcagtggatattgtggtcgttgactccgttgctgcgcttgtgccgagagcggaaattgaaggggaaatgggcgattcccacgtcggcctccaggcacggctgatgtcccaggcgctgcggaaattatcgggtgcaatcaacaaatcgaacacgattgcgattttcattaaccaaatccgggaaaaagtcggcgtaatgttcggtaatcctgaagtcacaccgggcggccgtgcgctcaaattctactcatccgtgcgccttgaagtgcgccgtgccgaacagatcaaacaagggagcgacattgtcggcaacaaaacgaaaatcaaggttgtcaaaaacaaagtagcgcctccgtttaaaacggcagaagtggatattatgtacggcgaggggatctcaaaagaaggcgagatcgtcgatatgggaagcgaccttgacatcatccaaaaaagcggggcctggtatgcttataacggcgagcggctcggccaggggcgtgaaaatgcgaagcaatttttaaaggaaaatgcggatctgaaaaacgagattgccgcaaaaatccgggaacattacgacctgacagaagatgccggttcccatgaaaccgagaaagctatagatgaacaagaagctgtggaaggacaggaagaattaaatttggagtaaccggtgtataagcgcctgaaatgctgaccgcatccaggcgctttttgccgtccatttaccgcacttttttgcgccacaaaatctgcatggcggagaggaatcaacacaaatttacaatggcaatctttccgcttcacttgacaataaaaattcccacctttaaaattaatatgtatattttatttttctaaaaatgactttctcctgtacggaaagcaaatcctcccggaagtttccggaaggggggccggttttttcatccggcggcttttccgcatgcggctgatggaaccatccttgtcttcagccggaccgggacgaaacgcatgattgggttttcatgcatatacaccggaggggcttgccccgggatcaacgttttactttttaagccaggcgctgtatactgtaaacctaaggattaatgtaacagccgacatttttaacgtagaagaagttcatagcaagaggaggtgagattgatggagtctctcatatggatcatctcccttttgcttgtccttatcgtcggtgtagttgttggctatttcatccggagatcaatttatgaagcgaaaattgcaggggcgaaaaatgcggcagatcagatcgttgatgaagcaaaacgcgaagctgatcgcctgaaaaaagaagccctgcttgaagcgaaggatgaaaatcataaacttcgtacggatatggaacgggaattgcgtgaacgaagaaatgaattgcaaagacaggaaaaccgcttattgcaaaaggaagagaacctcgatcgcaaagatgaatcgctcgataagcgtgaatcgatgcttgaaaagaaagaggattctttaaacctgagacaacaacatattgaagagatggaaagcaaattggaggagatggttaacgagcaggagtctgagctggaaagaatctcgggcctcaatcgcgaacaggcgaaagccatcattattgaaaaactggaaaacgagctttcccatgacattgccgttaaggtaaaggaagcggaaacaagggcaaaagaagaagccgataaaaaggcgaaaagcattctttcgctggccattcagcggtgtgcagccgagcatgttgctgaaacaacggtatcggttgtcaacctgccgaatgatgaaatgaaaggccgcatcatcggaagggaaggccgcaatatccggacacttgaaacgctgaccgggattgacctgatcatcgatgatacgccggaagcggtgattctttcgggattcgatccagtgcgccgggaaacggcacgcattgcactggaaaaactggttcaagacggccgcatccatccggcccgcattgaagaaatggttgaaaaagcaaggcgggaagtggatgaacatatacgcgaagtgggggaacaaaccacttttgaagttggtgtccatggcctccatccggacttaatcaaaattcttggccggttaaaattccgcacgagctacgggcaaaatgtcctcaagcactcgatagaagtcgcattcctttccggattgctggctgccgaactcggggaagatgaaatccttgcccgccgtgccggtctgcttcatgatatcggaaaagcggtagaccatgaagtagaaggaagccatgtgcaaattggcgtcgaactcgcaaccaaatacaaagaacatccggtggtcattaacagtattgcttctcaccatggcgatacggaaccgacctctgttatcgcggtgcttgtcgctgccgctgatgctttatccgctgcacggcctggggcgcgcagcgaaacgcttgagcattacatcagacggcttgaaaagctggaggaaatcgccgaatcgtatgacggtgttgaaaaatcgttcgcgatccaggcggggagagaagtacgcattatggtgaaaccggaacagatcgacgacctggaagctcatcgcctggcacgtgatatccgcaaaaaaattgaaaatgagctggattatccgggccatattaaagtaacggttattcgggaaacgcgggctgttgaatatgcaaaataagcggtgacgtgttcaccgcttattttctttaacgttttgaaaagaaaataaagattgttttacaaagcatagaaaggatttattgcatgaagattttatttataggggatgttgtagggtcattagggcgtgagatggtgaatgaatatttgccgaagttaaaggcgaaatacaggccgcatttgaccatcgtaaacggggaaaatgcagccggcgggcgtgggattaccaaaaatatttaccgcggcctgctggatgcaggtgcggatatcatcacgctcggaaaccatgcatgggacaacaaagagattttcgactttattgaggatgcaaaatggatggtgcgcccggccaattttccggacgggaccccgggaaaagggatggcgttgatcaaagcggaaggaacggagtttgcagtcatcaacctgcagggcagaacgtttatgaacgcgctcgatgacccgttccggaaagcagaagagatggtggcactggcaagaaaaagaactcattttatctttgttgattttcatgccgaaacgacaagcgaaaagcaggcgatgggctggtttctcgacggcaaagtgtctgccgtgatcgggacgcatacgcatgtgcaaaccgcggatgcaagaattttgccaaacggtacagcctatctgaccgatgccggcatgaccgggccgtacgatgccattctcggcatggacaaagaagcggtaatgaaaaaattcctgacttcgcttcctgtccgttttgaagtgccgaaatcgggaaggaaaatattaagcggatgcatcatcagccttgataaaaaaacaggcaaagccgcaacgatccagaacattttaattaatgaagaccacccgtttatctctgaataaacgggttttttctttttccggatgggtgccgggcaggacagcgcctctttttatgtaccggtgcttatgaaggatggcataactcgcagaacaaaggaatatagtagcagtgaaatgatttttcccgctgtgcggggggcagctccccggagtttttttgagcaagagacgttcacgaaagcccgcacgacaagcaggaaaatcagtagcctatatgcggggcggctgccggattgtttcggacagccgccccgtttccagcgaagccgggaaaaggccgggctggaaacgggcaagagatacttcacgttcgaacatgaatcgtcactctgaacggacattcggttaacggaaggagacaaggaggagaaggaatggaaatattaaaagtttcagcaaaatctaatcctaattctgtagctggtgcacttgccggtgttcttcgtgaaagagggggggcggaaatccaggcgatcggggcgggcgccattaatcaggctgtaaaagccgttgccatcgcaagagggtttgtggccccgagcggtgtggatttaatttgcatcccggctttcacggatattcagattgaaggagaagaaagaaccgctattaaactcatcattgaaccccgctgatatagattgaaaagaaacgctgtttgcagaagcagacagcttttttttgtatggaaaaaaggtttgcggaaactgtcatactttatcagcaaaaagaacccgtccacgtgataaagtaaaatcgtggcgcgctttatctttgcgccttttttactgcagcctgaaaagtggctgaaggaggggtggaagttgatccatatcattgctactgctgaatcgtccaggcaggctgaagcgctgattgcggccggagtggataccctctatatcggggggaaccgtttcggcttgcgcatgcccggccatatcacgcttgaagacataggcgacattacaaagtttgcacaccggcagaatagaaaagtgtatacagccgttaacggattgatgcataacggccatatagaggcgcttccggaatatttgttatcacttgaaaaagcgggagtggatgcgattactgccggggatccgggcgtgatacagctcttaaaagaaatgaaactgaatctgccttatatttacgatgcacagacgcttgtcacatcggcaaaccagataaagttctggctcaaacgcggggcaataggggccgtggcggcgcgcgaatgtacttttattgaattaaaagagatacaggcgcaaatcaagcaacccgtcgaggtacaagtatacggcccgacatgcatccaccactcgaagcgccgcttgctttcgaattacacccaatttgcgcatcttaatgccggcacaactgtccgtgacaggctcagcatcagcgagaaaaaagacagggaaaatcagtatccgctttttgaggatgaaaatggcacccatattttttccgcagaagacattgcgctcattcggtatttgccggatctgcacagggcggggctggatacgtggaaactcgacggcattttggccgaaggggaaacctttacggatattgccgccctttatgtccgggcaaaagaagcggtgctgtccggcacttttgatgcggcgcgtttttcagctgagcttttgcaattgcagccggaaacgcggaagcttggcacggggtttttcctgcggcagccggatgaagtacagtaggagggagaatatgcgaaacatcatcaaaaaaccggaagtgcttgcgccggccggaaatcttgaaaaactggaaatcgccgtccgctatggcgcggatgccgtatatattggcggacaggcttacggcttgcgttcaagagccggcaattttacgtatgacgaaatgaaggaaggggtccgctttgcgcatgcccgcggcgcaaaagtgtatgtagctgcaaatatggtcggccatgaaggcgatgatgaaggggcaggggattttttccgcacattaaaggagatcgggattgacgctgtcatcatctccgacccgggttttatcaccatttgtatggaagaggcgcccggccttgccgtccatttgtcgacccaggcttctgcaacaaattacaaagcgcttcagttctgggagcaggaaggggtcgaaagggtggtcctggcccgcgaagtcagccttgaagaaatccgcgaaatccggaaaaataccggtatggaaatagaggcgtttgtacagggggcgatgtgcatttcgtattccgggcgttgcgtactgtccaatcatatggcgaaccgcgatgcaaaccgcggcggatgcgcccagtcatgccgttggaaatatgacttgtttgaaaatgaaggagccgacatcttaacagctggcggcgagccgttttccatgagtgcggtggaccttacgatgatccatcacgtgccggaattgattgaagcgggtgtgggaagttttaaaattgaaggcagaatgaagtcgatccactatgtttcgactgtggcgaatgtgtaccgggcgattgtcgatgcctattgtgaagatccggaccattttgtttttgacccggcgtgggaggaagaaatttggaaagtggcacaacgggaactggccaccggtttttactttggggaaccggatgcccaccagcaactgttcgggcgcccccgcaaaattccgaaatatactttcgctgcccgtgttttggattacgatccggctacaaaaatcgccacgcttgaacagcgcaaccattttacgacaggggaagaagtggagttttacgggccgggatttgcccgtttcacccaaaccatccgcaagctttgggatgaagacggcaagtgcattgaacgtgccccgaatgcgatgatgaccgtgaaaacaatcgtcgaccatcctgtaaaaccttatgatttgatgcggatacgcaaaatgccggtgagtacggcacgcttttcaaactttcctggacaggctccaagtgaatgaaaatttacctcaaaacggcgggatacaaaaatacgttcccgccgtttttgcatccccggctttcgtcaatttgccttccaatggtatgcaaaacaggtgaaactatgcaatattgcataagaaactttccgtttttccccctacccctccgaactcccgcgactgcttttcctgaattctgagtttttcaaatcctcctcttgtttttctaataattggtatgaaaattgcaaagatgtagaataataggccttcacatggatggaagcggagcagccttattagcgtaccaaaaagcaaacatctttgattcgtggaagagagagggaggatgataaaattggagaatgcgacattaaagcgttcactcggtttatgggccatcgtcggacttggattagggtatatgacgcctaccattgtgtttgatacttttggcatcgtatcaaaggaaaccaacggggtggtgccgcttgcctatatcactgcgttgattgtcatgctgtttaccgccatcagttacgggaagatggtaaaagttttcccgaacgccggatctgcctacacgtatacaagggaaacgatgaacccccatctcggtttccttgtcgggtgggcggcgttgctcgactatttgctgttgcccatggtgaatgctttaattatccggatttatatggtatccgtctttccaaacgtgcccgcctggatctgggtggtgacgtatgtagccgccgtgacgggcatcaatgtatggagcatggggaaaacgtccaatatgaacaccattcttgtcgtttttgaactcgtgctaatcggtgcttttcttgtgctggccgttgtacaattttcgcacggaatgggaaaaggtacggttttcactttcgatccgctttaccactccaatgtccgtttgagcgcggtcctgaccggagcgacagtcgtatgcttctcgtttatcggctttgatgcggtaacgatgtatgcggaggaagcgaaagatcccaaaatcatgccgagagcgatcatgctaacggtttttatcggcggtgcggtcttctttatcgccagttatttcgcgcaagccttgtttccggacgtttcccattttaaaaacacggatgacacattgcccgaaatcggattgtatgtgggcggaacgctgtttaaattattgtttatttccggtgcatttgccgccacggttgcgtccggccttgcttcccatgccagtgtttcgcggctgttatatgtgatggggagaaacggcgtcctgccgaagcgatggttcgggtacgtgcatccgaaattccggacccccgcatggaatgtaatccttgtcggcctggtgtcgctgcttgcgatcacgcccagcctggaactcatttcctcgtttatcaactttggcgccctgattgcttttacattcgtcaatttatctgttattgccttctttgtcttccggaaaaagcgctataaaacggcaaaagatgtgttttcctacctggtgatgcctttagccggggcagggctgacgggcgttttatggtccaacttgcaaaaagacgccctcattttcggcattatctggtcaggcatcggatttatttatatggcgatccaaacgaaatttttccgcaagcaggtcatcgattttcaattggatgaagcagaaaaaacttctattctttaagataaaaagcaatggttacatggcagaagatgtgcaggcatcttctttttttgtgccggactatttccaatattaaaatatagtgatactatatttttagaaggtgcaaggaggaatcgcaatgccggcaattgcaaaagaaaaaataaagccgatcatccccttttcggttgacggtgaagaagatttaaggctggcgttacaaaagcataaagggccttttctgtttttaaagaaggacggagaattatttgcctatgccttgctgaatcatcaactgctggaaaagcttaaaaaaggcaacttttcaaaagaaaccctgcttcgccacgcaaaaccgcttgacgggatcagccgtctcgatgaccatatttccattacgagcttgttccaaatcattggtgaaccatttgcgcttgtgagaagcgaagatggccgcccgtccggctacatccaaagagaggacatgctggcggagctctttaaacaggaaaacgaaagcgcccactttctgaaaatcttgctcgcatcgatcccaatgggcatttttgtgctcaacagggaaaaacggatcatccattgtaacgaagcaggtttacgaatgattaaattgccgcacgaagcggtgctgaatgcccctggtaaaagtattttcagccatgaccatatcgcaaaagcgtttgaaaccgggaaaacgtatctgaaccatcttgaattcgcaaacggggtcggggttttggccgactacagcccgattcaaaatttcgccggtgaagttgaaggcctgatcattgtcgttcaggatttgccgatggtagaagaaatggcacttgaaatcgaatatataaaagacttaaataaagacttgaatgcgattctgtcgacgatttatgacgaaattcttgtcgtcaatgcaaagggcgaactgcttcgctacggggagaacatcattgaagatttctggcaggtggacgtaaaaacgctgatcgggaaaaatatcctcgattttgaagaccagggcttattcaccccgtcggttataaggctcgtgatggaaaaacggaaaaaagtatccgttgtgcaggaaacgcggacgggaagaaaaattctggccgtcgggaacccggtttttaatgaaaaaggcgcgcttgaccggatcattattgcatcgcgggacataaccgagacgacccggttaaaaaccgaactgaaagagatgaaagaaatttcagcccggtacaaaaaagagctcgaccagttcaaaaacaaagaccggtttttgaaaaaaatgatttactgcagcccgaaaatggaaaaaatcatgcaccaggtaaagaaaatcgccgaattttcgtccactgttttactgtccggcgaatcgggcgtcggaaaagaagtcattgcccaggcgatccaccaattcgggaaaaggtcggaaaaaccgtttttaaaactgaactgcggtgcgattccggaaactttgctggaaagcgaattgttcggatatgtcaaaggcgcctttacaggtgcggaaaaaaacggaaaagaaggatactttaagcaggcggacggcggcattttgttccttgatgaaatcggcgaattgccggtgcacctgcaggtcaaattgctgcgggtgctgcaggaacaggaagtgatcccgatcggcagcacaacccccattaaaatcgatgtccagatcattgcggcgacaaatcaaaacctggcaaaaatggtggaagagggccggttccgggaagatttatattaccgattgaacgtcattccgatccggatcccgccgctccgggaacggccggaagatatatcgctgcttgccttccactttttgcagcaattaaacgaaaaatacggccggaagttttatttaacgcctgatgcgatcaatgtgctggaatgttacccgtggccgggaaatgtaagggaactgcaaaatattattgaaaggctggtcgtcactgcggaccatgctgccatcgatggcgggtttgtcagccagtttttaacattcggctctgaaaggaaaaaaatgaagccggtcgtcacaagaatcatgccgttgcaggaggcgatggagtccgtcgaggagcagctcattttgctggccatgaaccagtacaaaacgacaacaaaagcggcgaaagcactgggcatcagccagtcttccgtcagccgcaaataccaaaaaatattaaacaagaaaaacaggaaaacagaggatgccgttttcaagtaaagcttcttctaaaaacccctgctgccgcaaacaaagcctaaaaaacggcgggacgctaccattcacagtgtcccgccgtttttttgcagcctgcaacttgtttcagtgcctcccggtgtaaacgcgccggttttcttttttactttccccgctccgtttccatgcagaaaaaaatagcattatgcaaaactgcataatgctgtgcgtgcgaaaccgcataaatcaggctgaaaattaattggcacccttcttgcaagattattcgtcgaagagaataaaggaggatgaaaaatggtcggggtacaacaatccgtcatcaacctgaaaatgtatattaacggcgaatggatcgatgcagataaccgggaaacgcgtgccataaaaaatcctgcgaacggtgaaaccatcgccattgccccggaaggcaccacccgtgatgcccatgaagcagtggatgcagctcgaaaagcttttgaatcggggatatggtccggcattcctgcacaggaaagggcagcgtatttatttcaagttgccgataaaatcgacgaaaacgcgaaggctttaaccaggcttgaaacgttggacaacgggaaaccgttaagagaagcaagctatgatattgccgatgcggctgcctgtttccgttactacgccggcttaattacgaagcctgacgggtttacctaccatgtcgcagatccgatgcaggcaatggttgtccgggaacccgtcggggtatgcggccttatcgtgccatggaattatccgcttttaatgagcgtctggaaaatcgcgccggcactggcagccggaaatacgatcgtttttaaaccgtccgaggtgacgccggtgacagccatgaagctctttgaaatctttgaagaaatcggcttgccgaaaggtgtcgccaatatggtcatgggcgcggggccggtagtaggcgaggagatcgtcacccatccggaagtggatatgatttcctttaccggcggcacgaaaaccgggaaacatctgatgcggcaggcggccgatacgttgaaaaaagtttcccttgaactcggcgggaaatctccgaatattatttttgccgatgcagattttgaaacggccgttgattacgccttgtacggcattttcagcggggccggccaggtatgttccgccggctcgagaatccttgttgaagaaagcttgtacgaaagatttgtctcccattttgtggaaagagccgccaaaattaaagtcgggccgggggatgatccggatacggaaatgggcccgcttgtcagcgaagaacatatgaaaaaagtgctttcttatattgaaatcggcaagcaggaaggcgccaccttagcgcttggcggcaaccgcctattggaaaacgggctggataaagggtattttgtcgggccggccgtgtttgtggatgttaaacaaaacatgcggattgtccaggaggaaattttcggccctgtcgttgttattcaaaaattcaaggatgaggcggaagctgtaaaattggccaatgacacggtatacgggctggccggtgcggttttctccaatgacggggccaaggcgttaagggtcattaaaaagatccggtccggcattacgtggatcaattcctatcatcctacttataacgaagcgccgtggggcggctataagcaaagcggaatcgggcgcagcctcggcacattcgggctcgaagaatttcaggaaatcaaacaaatcaacatcaatttacaagtggaaccaaccggctggttttcacatgaaaaataaggagagatcataaatggggatagatatcaaacaagagaagaaaaacagcgaagaacaagcggtactcggttatattcataaagtgctgaatttaattgaaaaacaggaagtcacgcaggaagaagcggaatggattacgaaggaaacggtggacggattccgcgaatatgtgaatccgggctttctggaataccggaaaaccgtgacggaaggcggccagtttgcggcagtcgaatggtccgacagcggcgcctgttttaaagatgtaaacggcaaagaatatatcgactgtctgggcggtttcggaatctacaatgtcgggcaccgtaatccgaaagtcgtaaaagctgtgaccgaccagctgaaacgccaggcgctccacagccaggatttgcttgacccgcttcgggccatgcttgcaaaaatattggcggatatcacgcccggcgatttaaaatatgcgtttttcacaaacagcggaacggaaagcgtggaagcggcattgaaactcgcaaaaatgtacagcgaccggacaaccatcatttcgactacccgtgcttttcatgggaaaagcctcggttcattgtccgggacggcgaaaggcatgttccgcaaaccattccttccgcttgttccgggcttccgccatatcccgtacggcgacattgacatgatgcgaaaaacgtttgaaacatgcgcccttgtcggagaagatgttgcagccgtcatgctggagccgatccaaggggaaggcggcattattctcccgccggagggctacttgcaacaagtccgtgaactttgcgatgcgtttggcgcgctgctcatttttgatgaagtgcagaccggcatgggccgtaccggaaaaatgttcgcggcggaactttacggcgtcgtcccggatattctctgtctcgcgaaagcttttggcggcggtgtgatgcctgccggcgcggtggtcgcgaaagaagaagtgttcaaaagctggttcccgaatccgttcatgcatactaccactttcggcggaaatccgcttgcctgtgctgcggcaattgcaacgatcggtgtcctcatcgaggaaaagctgccggaacgcgcagctgttgccggggattatttcctgaacggcttaaaagaggcggcaaaaggccacgaagacattgtccaggaagtccgcgggaaagggttaatgatcgggatagaattccattcggatgaactcggttatgaagtggcaaaaggcatgtttgacgggggcgtgcttgtcgcaggcacattgattaattcgaaaactttgcgctttgaaccggcacttacaatcagctatgaagaaatcgaccaggttatccgtacgttcaaacacgttttatcgcaagtgaaggcataaaatgtaaaacggaagagaaacgcaaaaagcctctgcctgaaacaggaaggggctttttgcgccgggcacgaaggtaacggcttcttttttcccggtaaagcgcacagcccggtgttttgccaatgtgacaccggcacaaaccgcgaatgaatccgcgttaaatggttaaacaaacggcttttgaagtccggatgttccgggaatcgtgaaaaacttgacacataccgggaacgggggtttgttgtaataggagaaaaaaccatttatactggttatacgcatgatttttatatggttgccgcaaattgagcgcggcatggtgcaaacagaaaggggattgccatgaacgagaaacaacgtttggaacagcagcaagtgaaccctgtagagcctgcggacaaaaaatccgaaaaggactacagcaaatatttccaatcggtttatattccgccgaatttaaaagaagcaagaaaacggagccggaaaccagtccagtattttaaagacttcgaaatcgatgaagacttaaaaggcatgggcgacggattgaaattttacatccggacttacggctgccaaatgaacgaacatgacacggaagtgatggccggcatttttatgcagcttggttacacaccgaccgaaacggtggaagatgcggatgtggttctgctaaatacatgcgccatccgtgaaaatgccgaaaataaagtgtttggcgaaatcggccacctgaaaccgttgaaaacggaaaaaccggacatgctgatcggggtttgcggctgtatgtcgcaggaagaatccgtcgtcaataaaattttgcaaaaacacccgcatgtcgatatggttttcggcacccacaacattcaccgcctgccgcacattttaaaagaagcgtatatgtccaaggcaatggttgtggaagtatggtccaaagaaggcgacgtgatcgaaagcctgccgaaagtgcgcaaaggcaacatcaaggcatgggtaaacatcatgtacggatgcgataagttctgcacgtattgtatcgtgccgtatacgcgcggaaaagagcggtcaaggcgtccggaagacatcatccaggaagtgcgtgaactggcagccaaaggctacaaggaaatcacgctgctcggccagaacgtcaatgcctacggaaaagattttgatgaccttgaatacggacttggcgatttgatggatgatctgcgcaaaatcaacatcccgcgcatccgctttaccacgagccatccgcgcgatttcgacgaccgtctgatcgaagtgctggcgaaaaaaggaaaccttgtcgagcatatccatcttcctgtccagtctggttcaagcgaaattttaaaaattatgggccgcaaatatacgcgggaacaatatttggaactcgtcagaaaaatcaaagccgcgattccgaatgtggcgctgtctaccgatattattgtcggtttcccaaacgaaaccgaagagcagtttgaagaaaccttgtccctgtataaagaagtcgggttcgaaacggcctatacgtttatttattccccgcgcgaaggcacgccggcagccagaatgaaagataatatcccgatggaagtgaaaaaggaaaggctgcagcgcctgaatgaactcgtcaatgcctattcaaaagcggccatggaaaaatacgaaggccaggttgtggaagtgcttgtagaaggcgaaagcaaaaacaatccggaaattttagccggttacacacgcaaaaacaaactcgtcaacttcaaggggccgaaatcagcaattggaaaacttgtgcaggtaaaaattacgaaggcgaaaacatggtcactggacggggaaatggtggccgtgcctgatccggccggggtggaagcgtgatgcagaagtttacaaaagatgatatcgtcgcaaaagctgccgaacttgcgaaaatgattgcggaaacggaagaggtcgatttttttaagcgggcggaagcgcaaatcaatgaaaatgagagagtccgcaatttaattgccaatattaaagctttgcaaaagcaggctgtcaacttgcagcattatggaaaaaaagaagcattaaaacaagtagaagccaaaatagataaactggaggaagaactggacggcatcccggtcgttcaggaattcaagcagtcacaggtggacgtaaacgacctgctccagattgtcacaaataccatttccaatacggtcacggatgaaatcatcaaatcgaccggcggcgatcttttaaaaggccaaaccggatcccaggtgaaatattcttccggcaccctccactgaaaaaaacggtgtgcatctgtgcacaccgtttttttggtgcgcagcacaaggcaaatccattgtacgggcaccctcctattgtcgcggcatatgttaggattacccggaggtggcgagaaaaagaattggcacaccggcctgggtaaaagcataggatgaattgaaaatagatgaggagggttcgctcgaatggcagaatatagagaaatcattacaaaagcagtcgttgcgaaagggcgcaaatttacgcagtccaatcatacgatttgcccgccgcagcatccttcgagcattttaggctgctggattatcaaccataagtacgaagccaggaaaatagataaagaagttaaaatccgcggctcttatgatgtgaacatctggtattcccataatgacaatacgaagacatcggtcatgacggaaaaagtcgagtataccgataccgttaaattgcattacagggatccggattgcctggacgacaaagaagtcatcgcaagcgtcctgcagcagccgaattgcattgaagcggtcatttcgccaaacggcaataaaatcattgtcagtgttgaaagagagtttctcgtggaagtcatcggagaaacaaaggtttgtgttgccatctcgcctgaaggatgcagcgatgacgatgaatgggaagaagaaagcagcgacgagtttgaagaattaaaccctgactttttagtgggaagtgaagaagaatagaagccacaaactaggagacatgcactcctagtttttttctgggcatccggcggtaaaagcgcggccatttgccccaccaaaacgcatgcttagaatgcacgcgaaatcctgtaatgggttttgacacaggcagaaaaaacctggcatccctggaggagacattgaaaatcaacagacaaggcccggctttgtaaaatgatccgtatttcaatttatgaaggccttcatgcaaatatgttataataaacaggattgaagaatgattgaaaagcaggaaaggaatttggtaagaatggctgcgtataccccaatgatccagcaatatttgcaagtgaaggcggaatatcaggatgcctttttatttttccgtctcggcgatttttatgaaatgttcttcgaagatgccattaaagcgtcccaggaactggaaattacattaacgagcagggacggcggcggcgacgagaaaatcccgatgtgcggggtaccgtaccattccgccagcacttatattgaacagctgattgataaaggctataaagtggcgatatgtgaacagatggaagacccgaaactggcaaagggtgttgtcaagcgggaagtcatccagctgattacccctggcaccttgatggagggcaaatcgctcgcggaaaaagaaaaccactatattgcgtctgttgcatccccggcggacgggaatttcgcgattgcctatatagatttgtcaacaggggagggcagggcttgtcttttggaaggcccgtttgaagaagtactgaacgaactggcgtcgatcggcgcaaaagaagctgtggtagatccggaatttccggatgaatacgcgcggctaatgaaaaatacaggaaatatcaccatttcgtttgaaacggatacggctgtaaaggaaggctttgaaaggcttctgccccagttggaaccggagcttttgcggctggctgcagcaagactgttaaactatttattccgcacgcagaaaaggagcctcgatcatctgcagccggttgaaatgtatgaagtccgccggtttttaaatattgattattactccaagcgtaatctcgaactgactgagacgatccgcgggcaaggcaaaaaaggatcgcttttatggctgctcgatgaaacgatgacagccatgggcggcaggcttttaaaacagtggatcggccggccgctgcttaagcaggaaaaaatagaagcacggcttcaaatggtggaaacctttttaaaccattactttgagcgggaggatatccgcgagcgcctgaaggaagtatacgacctggaaaggcttgccggccgggtggcatttggcaatgtgaatgcacgtgacctcatccagctgaaatgctcgctacagcaaattccgggtatccgggcggtcatggaaagcttggaaagcccggaaagcaaaaaattggcggcgcttcttgacccgtgtgaagaactgacagatttgctcgaacgcgcgattgaggacaatcccccggtttccgtgaaggaaggcgggatgatccgcgacggctataacgaagagctggaccgctaccgcgacgcgagcaaaaacggcaagcagtggattgcaagcctcgaacgcgacgagcgcgagcggaccggaatcaagtcgctgaaagtcggatacaaccgcgtgttcggctactatattgaagtgacgaaggcgaacctccacctgctcgaagaaggccgctatgaacggaaacagacgttggcgaacgccgagcggttcatcacaccggaattgaaagaaaaagaagcgcttattttacaggcggaagaaagaatgatcgatctggaatacgagctgtttacggaaatccgggcacatgtaaaagaatttattcccaggctgcagcgcctcgcaaaagcggtcagcacgattgatgtgctgcaaagctttgccgtcgtaagcgaaaaacgccactacacaaagccggtattccgggaagacggcgtgctgaagattacggaagggcgccatccggtcgtggaaaaagtactcgattcgcaaagctatgtgccaaacgactgcctgatggatgaaaaccgagagattctgctgattaccgggccgaacatgtccgggaaaagcacgtatatgcggcaaattgcgctgacggtaatccttgcgcaaatcggctgctttgtgccggcacgcgaggcggagctgccggtttttgacaggatttttacacggattggcgcagccgatgatctcatttctggccagagtacgttcatggtcgaaatgcttgaagcgaaaaacgcgattgcaaacgcaacggaacgaagcctgattttatttgatgaaatcgggcgcggaacgtctacatatgacgggatggcactcgcccaggcgatgatcgaatacatccatgatgaaatcggggccaaaacgcttttttccacccattatcatgagctgacggcgctttctgcggaactgggcaagctgcaaaacgtccatgtcagcgccatggagcaaaacggcaaagtggttttcctccataaaatcaaagaaggccctgcagataaaagttacgggatccatgtggcaaagctggccggcctgccggaacaagtgattcgccgcgccgaaaaaattctccatgcgcttgaaaaccaggataacggcgaaacgcagatgaaccccccggaggcggctgctgccacagagcccgcgcaactgtccttttttgaagagccggaaacgccgcgtcagaaaacggttgaagcaaaggaaagaaaggtgctcaagcaaattagggaactcgatttgctcgagatgacgccgcttgcggccatgaatgcactctatgagattcagaaaaaattaaaaaaataggtggtgttgtccgcgatgggaaaaattgcacaactggacgagttgctttctaacaggattgcagccggtgaagtggtcgaacggccggcatctgtcgtgaaggaactggctgaaaatgccatcgacgcggaaagcacagttatcgaaattgatgtctgggaagccggtatggaaaaaatccgtatgattgataatggaaccggcatcgagcctgacgatgttgagcttgctttctcacgccacgccacaagcaaaatcaaaaacgaacatgatctgttccggattcgttcgctcggttttcgcggcgaagcgctcccgagcattgctgctgtttcccgtgttgaaatcgtcacctcaaccggaaacgggcccgggacaaaagcggtcattgaaggcgggaaatgggtggcccgcgaacaggcgccgagccggagaggaacggaaattacggtcaccgatttattttttaacacgcctgcgcggttaaagtatatgaagtcgatccataccgagctcggcaatattaccgatgtggtgaaccgcctcgcgctcagccaccccgaggtgtctttccgcctccgccacggcggaaagatgctgcttcagacaagcgggaacggcgatgtgcgtcaggtgcttgccgccatttacggcgtgaacattgccaaaaaaatgattccggtacaaagtcaaacacttgattttgaaatcaacgggtttatcgctttgccggaaattacgcgggcttcacgcaattatatttccacgatggtaaacggccggtttatcaaaaattatgcgcttgtaaaggccatattagaaggttatcatacactgctcccgatcggccgctacccgattgtgttgatgtcgctaaaaatggatccggttttagtcgatgcgaatgttcacccggccaagcttgaagtgcggttcagcaaagaaaaggagctgtgccgggcgattacgggcgcgattaaagctgctttcaaaaagcaggaattgattccgtccggcatggtgcggcaagcagaaaaaccaaaacaggaacaggtgtcgttccagcttgaccatttgccgggaaaaacggaaccggaaactccgaaagctttctccgcgcctgttgcgccgcacccatcgccccggccggaggaaacggaaatggggcagcacgataaaagcccggatgcagaaccccatctcagcgtggaacagccggccgcagatttcccggcattttcaggggaaaatctggattctgtttttccagatgaaatccatgaaccggcgcgcgatggatttgatgttgaagaggcaagagggcaggacgcggcacagcagccggcatcccgcatcccgccgatgtatccgatcggccagatgcacggcacgtatatttttgcccaaaatgaaaacggcttgtatatcattgatcagcacgccgcccaggagcgggtcaagtatgaatttttccgcgaaaaagtcggcgaagtgaaaaaagaagtgcaggaaatgcttgtgccgctgactttagaatacgcaacggacgaagccattaaaattcaggagaacctcgatgcgctgaaagaggtcggcgttttccttgaaccattcgggcacaacagcttcattgtccgttcccatccgacatggtttccgaaaaatgaggaaaaagaggtcattgaggaaatgatcgagcatgtcctttctataaaaaaagtcgatattaaaaaattgcgtgaaaaagcggcgattatgatgagctgcagagggtccatcaaggcgaaccggcatttgcgcaatgacgaaatccaggcactgctcgatgcgctccgaatggcatccgacccgtttacatgcccgcacggccgtccaatcatcatccattattcggtgtacgaactcgaaaaaatgtttaaacgggtcatgtaactcccggatcgcgaaaccccttgatgatcaaggggtttcaatctttttaacgggtgtttgaccacaatttgaccacatttcaaacatgtttgagatcgttgtattgttcaaccttttactagcgtatcgataccatcttccactaaaggcccatcagcccgttaacgataagtgctttgggtgaaatatgggagttggtacagtttttgttctggttctttttggtttttgtcattcattgtgattctaagaaaaagcctagggggcctttactatctttcacaagcgatattatcatggtccctgtctttttctttattgttgtcatacaaggcttttgaaacgtatggcttataatgcgtttttccacctttgttttttgcgcttttacttcttgcaacaccgcctttgtaatctttattcaaggctttacagttggcataaatctttgtttttgccgcatcaacatcatgagaagtagcaaatgataccccgaaaattaggccggaagccactgcaactgaaatgatttttctcactataattctcctccaagttcacttaaatgattttatatagtcacaaatgaaaaggatgttataacttccatatatacctaattcttgtagtggacggaacaacttcggtatgagcaattggacaccatcgtgttaaagaatatagaatacatatctatcaagtagactgaggtttcgatgcattcatccgattttcatctgcaaatgactttacagacgggcaatttccttgacctatccgatttggtcattgatttttactttgcttcatcatattaatttcgagttctgcgtctgcaacttttctatttacaaaaatgacaccattccgaagatctttgatttcctctttgacgcctgcaatctcaccgtggagatggtggacatccattgatagggcatcaatttttgttgcagttgtttcttctgaacggtcgcgtatggctctgacaatttgtcccagttctttttggcctgatcccataacttccaatctttgtttcatttctttttgacccgattctaggacttcaaacttattgttcagctctttttggccggattctaaggcttcaaacttttggttcagctctttttgacccgattccagtgagcttagcttcttaaggataagttccagcttctgatccattatcaatctcctttcaaatggttttgatgagcttcttcttcggggtgaatttctatcaccatccattatatattgcatttttaatccaatccataggaattcatctctgtcctgaaaatatgcgccggctgattctcatcttccgctggcattcaatacggcatcggcatcttatttgttttgcaaggcgcagattgctttcaatcacgggccgtacaagtccttttgtttcctcgtcgattgcaagcgccacgccggaggccacttttccaggatgcaacggctgacgggccaccatcacgacgacgtgcagaaaagcagcgactggtctttgttttaaggtattgggcggatggaaggaattaatcatggaaagagccgtctttgctttgtgcgagcattaccagctggtattcataaatcagtttgtccaataattggctttggcggattgtttccgggtggttcatgccgttttgtttggcacactgcatcaattgttcgcggaggatgaaaatattgcgggacagatgggcagaggcaagtatgagatactgattcgttttttccatgcaaacatccctttcggagaaaaataagaagattagaaaaacagttttgaagaaaaggcagcatgagcgtgttttggaggcggttgtgcttaagatggtttttttgcggagctggcaggcatatcgtttgaatcagggtcaatggcatgcctgagcaaaacgatatcttcatatatgctttttttcacagcctcatacgggcatttgtggtattcatctaaaagccgccctaattcaatgatgaaaatgatgcgttcgtcatttttaaccatacgaaaaaacctgccttacatagatcataatgattatccttattatatagtataaatggaccggatgtgaagcaggactttagccctatacacacttttttaaatattttttcgtaagtgaattttcaaggatgaataaaatcccgaaaaaagggaaactgtatagatgttctgtttgctgttttatggtacgatagagacggaaaaatccggggatttaaagaatgctgcaatctccggcataaaaggtagggtacgaatggcaaaacaaaaactgatcgtactgatcggcccgacagcatcaggaaaaacggcacttagcatccgcctcgcgaaaaaattcaatgctgaaatcatcagcggcgattcgatgcaagtatacagaggcatggatatcggcacagcaaaaattacgcaggctgaaatggaagggattccccatcacctgatcgacattaaaaatccggatgagtctttttcggttgctgaattccagcaactggtacgggaaaaaataagcgatattgcttcccgcggcaagttgcccatgatcgtcggcggcacagggctttacatacaatctgtcttatacgattaccgtttttcggacattgccggagatccggcataccgcgcggaacttgaaaagattgcaaggcgggaagggcccggcctgctttataaattactggaaaaaaccgatccggaaagtgccgcaaagattcatccacataatgtcagaagggtgatccgggcgttggaagtaggccatttttccggtaggacgatgcaagactacaagaaacagcaacaggatgaaccgctttattgtgcggcgctcattgggcttgtgatggagagggagaagctgtatcaacgcattaacgaacgggtcgatcaaatgatggaacgcggtttaatcgaggaagtgagaaagttgtatgacaaaaatttgcgcggtgtccagtccatccaggcgatcggctacaaagagctttacgattactttgacgggcgcatgacccttgacgaggctgtttcccgcttaaaacaaaatacaaggcgttttgccaaaagacagcttacctggttccgcaataagatggaaattgagtggtttgacatgacaaaagaggaagaaaaggaaaaaaaatttgaagaaatttccgctttcatagcaggaaagctacaattaaaatcgaatagtttataatatagagtatagccaggaacacgcgtgacttcagtcatgagatgctccgggcaccgaaccgcagaaactgcgggggctgcctgctaaaatcaccggagatccaccggcgtttgcaggaatctcgcggctttagtcatgagcaggttaaaatagagagaaagaggaggattcgcaatgaacaaagccatcaatattcaggaccagtacttaaaccaattgcggaaagacggtacggttgtcacagtctttttgatgaacggctttcagcttcgcggccaggtaaaaggctttgataacttcaccgtgctgattgaaacagacggcaaacagcaactcgttttcaaacatgcgatttcaacgttccagccgcaaaaaaatgttcaaatcaatttcgaggaaaattaaaacaaaatgtccggcagcttgccgggcattttaaatatgtgtactgttatccgcttctgaaacataaactgatacagatcattatttctcgggaaagcgcaaaaaccgacaatttcccccgccattttggatggtgctgattttcgaccggtgcggatttgaaaaacaaccggttttcttatgccggacaacaagtttttgtacgtgggcatttgtcacactcccggcccaatccgcgtatattgtctgtagaatgcgaggtggcggtgatggatcaaccgattcgtatgaaaaataacggccagatcaatattgtcctccatgcgggccaaagggaggccgttattccccagccgaaaatagaaaccggcaaaaaagatttatcagcagaacatgaaattttaaaagaaattgaagatgaacttggcacgctcgtcggaatggaagaaatcaaaaaaatggttaaagaagtttatgcctggatctatattaacaagaaaagggaagccgccgggttaaaaacgggaaagcaggcccttcatatgatgtttaaaggcaatcccggaaccggcaaaacaactgtcgcccgattgatcgggaaattgttccataaaatgaatgtattgtcaaaaggccacttgattgaggcggaaagggccgatctggttggcgaatacatcggccatacggcgcaaaagacaagagatttgattaaaaaagcgatcggcggcattttatttattgatgaagcgtactctctcggccgcggcggcgagaaagatttcgggaaagaagcaatcgatacgcttgtaaagcatatggaagacaaacagcacgaatttattttaattttggccggctattcaaacgaaatggattatttcctgagcctgaatccgggactgtattcccggtttccgatcgtgttcaactttcctgattactcggtagaggaactcatggatatcgggaaaaggatgctgacggaaaaagagtatacgctcagtttggatgcagaacggaagcttcgcgatcatctggcttttgtcaaaacaacgagcacccctgccagtttttcaaacggccggtatgtgcggaatgtaattgaaaagtcagtgcgcgcccaggccatgcggctgttaatgcaggcttgctatgaccgccatgagctggtcacgctgcgcagcagtgaccttgtttttccggactgacgcctgcatcctatgcagtttgcagcaggcgcttattttccgtagggaagcttaaatcggctttttcggccagatgtttcgcacggaaaataagcagcccgggaagacatttttaagaaaggtaagcccgggcataacagcgcccgggcttttttaatgggggcggtaaaaaagcgatatcgcatgaagccatgccctgtttcccaaaaaaagcgcctcgacatgttatacttgggcgttttttggtaagataacaggtatactggacggaacaggtgatgaaatggaaaataaaaaagaaagagcaattcttgtcggatgcgaatggagcggcatcagccacagccgttttgcctattcaatggaggagctgaagcggcttgtcgaaacggcgcagggggaagcggtgcttgaagtcgtacaaaaacgggacagggtagatgctgctacgtatatcggaaaaggcaaggtagcggaactaagggcgcttgtttcagaactgcaagctgatctgattgtttttaacgcggaactttcgccgagccagctccgcaatctccaggccgcggtggattgccgcgtgctggacaggacacagctcatccttgatatttttgcgacgcgtgcccgctcaaaagaagggaagctccaggtggaactggcgcaacttgagtatttgctgccgcgtcttggcgggcgcgggacggagctgtcgcggctcgggggcggaatcggcacgagggggccgggggaaacccagcttgaaacggaccgccgccatatccgccgccgcatttctgaaatcaaggcgcagcttgaaacggttgtccaccaccgggagcggtaccgcgaaaggcggaaaaagaaccatgtgtttcaaattgcgcttgtcggctataccaatgccggaaaatcgacattgtttaaccgcctgtctgccgcaaattcttatgaagaaaaccagctgtttgccacgcttgatccgatgacaagaaaagttgtgttgccaagcggttatacggctttgttgacggatacggtcggatttatccaggacttgccgacgacactgattgcggcgttccgctcgaccttagaagaagtgcgggaagccgatttgcttttgcatgtcattgacagttccaacccggattatgacaaccatcaaaaaacggtgcagcgcctgctttccgaactggaaatgaaccatctaccgcagcttgccgtttacaataaaatggatataaaagacagccatttcgtgcccaatgcacaaaacagcatcatgatcagcgcgaaagacgaaaaagacatccaccggctgctgttggaaattgaaaaacaagtgttggccgaaatggtgccgtatcgcgcgcttgtcccgcaaacagaaggaaagctgctttcagttttaaaaagtgataccattttaagagaactaatttttaaagaagaaaatgaggcataccagtgcaagggatatgcgcttccaggccatccggttctgggcgcgatacaacaatatgctgaataaaaaccttgcgcgcgggtgcatgcagcgggttgccttgcatgcaccccatattttgaacggaaaggtgtagaagatgtaccagtatttgactcatggtgccaaactcaggcaaatggcagaagaggccgagcgtcaaattcgcccggtccacagcgcaatagaaaaacgggcggaagcgaaccagttccgcgttttgcaaagttttcaaaagtataaagtgagcgagtcgcatttttatccgtcgaccggatacggctatgatgacgccggcagggaaacacttgagaacatatatgccgatgttttcggcgcggaagccgggctcgtccgcccgcaaatcatttccgggacacatgcgattacgattgcgcttttcggcgtcctccgcccgggggatgaattgctatacataaccggaaagccgtacgatacgcttgatgaaattacaggggtgcacggtagtggcaacggttcgctgcaggagtttaacataacctataattatgtaaacttgaaggaagacggcacggtcgattttgaagcggtaagaaaagcgatccatccccatacaaaaatggttgcgatccagcgctcaaaaggatatgcgtcaagaccttcgtttacagtggatgagatcggggaaatgatccgctttgtaaaagaaatcaagccggatgcagttgtgtttgtcgacaactgctacggcgaatttgtagaggagaaggagccatgccatgttggcgcggatttaatggccggttcgcttatcaaaaatccgggcggcgggcttgcgaaaacgggcggctatattgtcgggaagaaaaaatgggtggaaagctgcgcttacaggatgacatctcccggaattggcgcggaagcaggagcatcgctttacagccttcttgagatgtaccagggcttctttctggcgccgcatgtggtggcagaggcattaaaaggtgcggtgtttacatcggcaatcttggaaaaatccgggatgaatacgtatccgaaatgggatgcgccgaggacggacctcatccagtccgttgaatttggcgacccggacagcatggtcgccttttgccaggcgattcagtttgcttcaccggtgaattcttatgtgacgccatatccgagtgatatgcccggttatgcggacgatgtcatcatggcagctggcacgtttatccagggggcaagcatcgagctttccgccgacggcccgctccgcccgccatacaccgcctatgttcagggcggccttacgtatgcgcatgtcaaaatggccgtcctgctcgcgctcgaccggttgatggaagaaaatcttgtagatcccagttgaatttttccctgctttgatctacggtcggctggatttcaaccgggcacaatggttcgcccgtttagaaccgccttttttcaatgcggccagttgctggttgtgttataataacaggatgatatttgatgaggtgatcgcatgaataagaggccgcatttgcttttaattgacgggatggcgctccttttccgggctttttatgccactgccgtgacggggcagtttatggtgaattctaaagggatgccgacaaacggcgtgcagggctttttgcgccatttgcttttggcggctgagaacaaaaaaccgacgcatgtggccgtttgctgggatatggggagcaaaacgttccgcaacgacctgtacggtgaatataaagcaaaccgggacgtcccgccggttgagatgattccgcaatttgacctggcgaaagaaacagtggaagcttttgaaattccaaatgtcggagtggccgggtatgaagcggacgactgtcttggcacccttagcagccggttcaaagacgaggcggatatttccattttgaccggcgaccgcgacatcttgcagcttttggatgaccatgtggaagtccatctcctccaaaaagggttcggaaattataaaacctatacaaaggcggcgtttatggacgaatacggggtgacgccgcggcagtttatcgatgtaaaagcgctgatgggtgatacaagcgacgggtatccgggtgtgaaggggatcggtgaaaaaacagcgtttaagctcgtcagccggtttggaaacatcggcggcattttggaacatctcggggagctcaccccgtcacagcagaaaaaaatcgaagcgggattggagatgctgcacctgagcagaaaacttgctgaaatccgttgtgatgtgcctgtggctttttctttggaagaagcgcggtttggccagattcctgaaacgtttatggaactgatggaggaactggaattaaaaatggtaaaacgccatttagttacagcgcggataaacgcaagcttcatttcttaaccactttgcccggtttaattggggacggaaagtggaaaaacagcattcaggacaagaatgctgtttttcttctccgttttgcgattgtcagatttttgtattggactttttcgcgcggttttcaagggttgtctttgggtccggcgcgaatgccgcatcctgtgcgattccttgcggcgtaacggaatttgccgctttaccgcggtttgtattgtcttttttagccatcctgatcacctcttgttatagcatgcccaaattcggggaaattttgataaagggatccccgggaaagtccggcgtgccgcaatggataaatgcacgcgcaatgcggatgggaaagctggcggaaagaaagaagggataaagatggaaagaaaacaactcatccgggaagtggatgaaatattgaagacgtattgtgaaggctgttttttaaaatcgcatttccggaaaacacgtgggaaaaaatatgcccaccagttttgcatccggcaatgcacggtaggcgaaaagctgaaaaaatacggcgaccggttatcgtgacgggtattacaaaatgcgggaaacaggcggcacccgaaaacggttgcccgtcttgccgtattaaatcgaacaaagtcggctcagacaacaggcgtggcggaagacatcgcagacttgtaaacagtatactgatgcaacaaccggaaaaatgccacaatccggtattgtgaggacttacacaaatgcagaaaaataaaaggctggcataaaagccagcctcgttgcattctatgatttatgaaagttttgttacattcgctgcctgaggtccgcggttgccttcaacgatgtcgaaagaaacagcttggccttcttccaatgttttgaatccttcaccttgaatagcggtgaaatgaacgaaaacatcgtctccaccttcaacttcaatgaacccgtagcctttttcgttattgaaccattttactttaccgttttgcatttcttaatcctcctaaatcaaaagcacgttcgtgccaaaaaatgttgcattaaacagatgaaaaaccgccatcaaggtctgggaaatcacttgtttaatgttataattaatatactccatccggtatggatagtcaagacaaacgaatcaaaaatgagggaaaattgttgtgaattcttaaatttgcaagcggtttaaaactggcgcagcttttttcaggaattcttgtacatcatccgtgattatagtaaactgatggtattgttattgtaccggcagactcaatatttgttgtaagaatgggggcccgtggatgccgacacctagtatggaagactacattgaacagatttttattctgattgaaagcaaaggatatgcgcgtgtttctgatattgcagaagcgctttccgttcatccttcatccgtcacgaaaatggtacagaagctggataaggatgattatcttgtttatgaaaaataccgcggactggtcctcacccctaaaggcaaaaaaattggaaaacggctcgtcgaccgccatcatttgcttgaacagtttttaaggatcatcggggtcgacgaagaaaatatttatagagatgtagaaggaattgaacatcacctgagctggaattccattgaccggatcggagaccttgtccaatactttgaggaagatccgggccgggtgaacgacctgaagcggcttcaggcacaaaacgaggattgaattttccggcctccctgcccttgaaatgggtgctggttcctttttatgcaccggatgatggggcatgttgcctaaaaggctgtctgccggcacgcatcaggatttagaaccctccctgcttgatgcaagcagggctctttcccgccagccggaaaacaaacttcgcatggcgcctttatgcagaaaattagggctagagccaaacgattttccggtatgggtgaaaaaatccttttttcaggtgcaatgggctacaggggtatgtagaatagaagatggaagcagatttttgatgaagcggaggatttgacattgccaagccattcgattggaaagacggatattgatattgcacagcatgcttcgctgaaaccgatcaaagaaattgcggaaaccgtgcagcttgcagaagaagaccttgaatattacgggaaatacaaggcgaaaattacatatgaaaaaatcaagcagcttaaaaccaaaaaagacggaaaattatttcttgtcacttccatcaatccgacgccggctggggaaggcaagtcaaccgtcacaatcggactcggcgatgcattaaaacagctgggccataaaaccgtgattgccttaagggagccatcactcggaccggtcatggggctgaaagggggcgcaacgggcggcggttatgcacaagtcttgccgatggaagagatcaatcttcatttcacaggcgattttcatgcgattaccgctgccaataatgccatttccgctttgctggacaatcatatccaccagggaaatcgattgcagattgaccagcgccgcattgtctggaagcgggcggtcgatttaaatgaccgggcgctgcgccatgtggtcgtcggtctcggcggtcccggccagggcgtgccccgtgaagacggatttgacattacggtggcttctgaactgatggccgttttatgcctggcggaagatctcgaagatttaaaaaggcggattgcgaacatcgttgtagcctacaattacgaaaagaaacccgtgaccgtcggtgacctcggaatcgaaggcgcgattgccttattgctgaaagatgctttgaaaccgaatcttgtccagacgatcgaacatacaccggcgcttgtccacggtggcccgtttgccaatattgcgcacggctgcaacagcgtgatggcgaccaaaaccgctttgaaactggccgattatgtcgtcacggaagccggctttggtgccgatctcggtgctgaaaaattcctcgacattaaagcgcgggcagccggcttgaaaccggacggcgttgtgattgtcgccaccatccgcgcattaaaaatgcacggcggggtgcgcaaggaagatttggcggcagaaaatattgcagctcttgaagccgggcttttaaacctgcaaaaacatgttgaaacgatcgcttcattcggtctgccgtttgtcgttgccatcaaccggtttatatcggacagtgatgcggaaattgctgtcttagaaaattggtgcagtgaacgtggcattcctgtgtcgcttacggaagtgtgggaaaaagggggcgcaggtggcatagatcttgcggccaaactgctggaagccgccaaacagccacatacattcaggccggtttacccgcttgaatcaaccattgaagagaagatagaggcgattgtgcgtcaggtgtatggcggccgcggtgccgaattttccgcgaaggcgcaaaaacaaatccgcgaatttgaacaattcggatggggacatcttcctgtttgtattgcaaaaacgcagtattccttatccgatgacccgcacaaaacgtgccgtccgtatgattttgcgatccatgtccgcgaacttgtcccgaagcttggcgccgggtttatcgttgccctgacaggagacgttctgaccatgccgggtcttccgaaagaaccggccgcttaccggatggatgttgatgcggacggccgcgcatccgggctcttttaaacgggggacaggcgatgtttgacccaactgcttttgaaaatatgaagactgtattcgaaggtgctgcctatgagcttgatttacgaggggaagcatccatcaccggaagaaaagacctggtcgacctggcggaaatgtcccgggaataccgcattacgcttcagcttccggaatggcaggaagcaagcgtaacgatctgtctttcggcttcgctcgggcagctggcggcggaaatactggatctcgcgtccggcgccaaagcgggtgccagtgcggccgtaactttttcctggaaaaacagagaccgatccgctgattataaacagattatcttttccgcatggggaaacggcaaccggcgccgcatcgaggaaaggactgtccgctcatcacgctcgggtgtaaccgaagaagttgccatcgattttgcccggctgataacggaagatttaatggatgatttgcttaagatgcccgcagatgccgtgaagactttgcgccggatgagggtctaacaaaagctgcatgctctgtcgtgcagcttttggcttgcttgcccaaaaaacatgataaaatgaaggcaaagaaaggggcatttatgtataaacatccggttcttttacagattgaactgttcgcccgcgctttccacagcggagatgcttccggtcatgactggcaccacattaggcgtgtccgcgggcttgcactctatattgcggaaaaagaggaaaaaggtgatcgatttatcattgaagctagcgcccttttgcacgatattccggacgtaaagctgaacgcggacaaccagaaaggggcgaaaaaactgaaggcctttttaaacagcctgccgctagcggaatatcaaaaagagcaaattcaaaatatcgttgcaagcatttcttttaaaggcggcaatgaaacagaactgttgcattttgaggcaatggctgtccgtgatgccgaccggttggatgcaatcggggcaattgggatcgctcgcgcattcgcatacggcggaaaaaagggtcagccgctctatgacccggaactgccagtgagaaaacaaatgactgaagaagaatatcgaaacgggaaaacttcctcgatccatcatttttatgaaaagctattacttttaaaagataggctgtacactgagacggcgaaaaaacttgcagaagaacgccactactttatggagcagtttttacaggaatttttcaaagaatggaatgttgaacgatgaaaatatttcaagctcagggactgacaaaatcttacggggaaaaagtgctgtttggtgatctttctttccacattggggaacaggaacggatcggccttgtcggcgtcaatggcaccggaaaatcgagcctgctgaaaatcattgcgggacaggatgaagcggatagcggggaactgagcacgccgaacgattataccattggttatttgccgcaggagcctgaactgaatccggccttcacggtccttgaacaggtatataaaagcgagtctccaattatggcgcttttacgttcctatgaagaggcgctgcttgaagtcgggaaggatccgggaaatgcagacaaacaggatcgattgttccggctgcaaaaagaaatggatgccggcggtgcatgggaagccggcgccaatgcacagacggtcctttcaaaacttggcatccgcgatttggacagaaaaatttcgggattgtcaggcggacagaaaaagcgggtcgcccttgcccgggtattaatggaaacacccgatttgttgattttggatgagccgaccaaccatctcgactatccggctgtcaagtggctggaagcatttattgcaaaatatccccgttctgtcctgtttgtgacacatgaccgctatttcctcgaccgggcggcaaaccggattttcgagcttaatggtggaaaactgtacagctacaaagggaattaccaggattttatggaagcaaaagcgcagcgggaagaagcgcaactgcagcaggaagaaaaacggaaaaatttgtacaggcgggagcttgcctggatgaagcgcggggcaaaggcgcgttcgacaaaacaaaaagcaaggatcgggcgttttgaagaactggaatccagcctcggtaaaagcccccggcagcaggaagccgatatcgctttgtccggcagccgcctcggcaaacaggtttttgaactgcagcatgctaataaagcgttcggttcagagacgattctaaaggatttcaacctgctcgtaaagccgggtgaccggatcggcatcgtcgggaaaaatggaagcggaaaatcaactttgatgaacattctcgctggcaggattccgctcgattccggggaacgcctcaccgggcagaccgttaaaatcgcgtattaccgtcaggaaacgccaggcatgaatgaagataagcggatgatcgagtatatacgggaagcgggggatacggtgacaacaaaagacggggaaacgatttccgccgcgcaaatgctggaaagatttctttttgacatgcacacgcacggcaccccggtcagaaaactgtcgggcggcgaaaagcgcaggctgtatttgctcaggcttctgatgtcgcggccaaatgtgctgcttttggacgaaccgacgaatgatctcgatacggagacgcttaccgtgcttgaagattatatcggagagtttccgggcgtcgtcatctcggtttcacacgaccgctattttcttgataaaaccgcggagcagctgcttatttttgaaggcggcggcaaaatcagccgctttttcggccgttacagcgactacctcgaaatcgcgcatgaaacgccggcacaggaggaaaaaacggatgtgccaaagcctaaacgggaaccgaaacgaaaaaaatggtcttatcatgaacaacgggaatgggaagagatagacgaaaagattgaagcatgcgagcaaaccattgccgaactgaacgaacaattggaacaagccggctccgattttgtcaaagctcaggaaatttcaacagcgctcgaagaagaaaacgaacggctggaaggccttattgaacgctggagctatctttccgaactgcaggaaaaaaacgacaactaattctgaggaaggcgacccgttttttgccggaaaagcgtgacagttggtccgtcgctttccgggctggaggaataggtggtagccgggaacatgctttttgaaaggaaaaaagggtgagcctacgaacgcgcaaaagatgttttccattttcaagatacgcttgatatttccgaaaagaatcaactcattcgtgtatccactgtgattatgttaaaatgcaagtagactggaatgggaaaggcggtgtggaaatgaaaattaaagcgattgaaccaacgccgagcccgaatacgatgaaagtcgtattgacggaagcactgccggacggcgcccgcagcaattataagaaagggcaggaagaaggggtgccgcctgtgatccgccgtattcttgatatcgaaggcgtgaaaggcgtataccatgttgcggattttctcgcggtggagcggcatggtaaaacggactggcaggacattttgccgaaagtgcgtgaggtgttcggggaggcggaaacagaaaccggaaacagccctcgtgccaatgagcatttcggggaagttcaggtgtttgtccagatgtttaaaggcattccactccaggtaaaactgacggacggggaacaggaaaaacgtttcgggctgccggcttattttgccgaggcgctggccgctgcgcaactggaaggcgacaattatgttttcttgcggaaatggaaagacttcggcgtgcggtacggagagatgcaagagatcggtgcggaagtcacagaagaaatcattgccgcttatccgaaagaaaggctaaaccggcttgtaaatgaagcgcagcatccggaacaggttcccgctgccaaaaaaagattgaaattaacgcccggcatgctggaaacggatgactggcgcaaaaggtaccggctccttgaacaaatggaagaccctgatctttccgacttgcctgttcttgaaaaagccttgggagatgaaaagccatcgatcaggcggcttgccgttgtgtatttgggcatggtgaaagacaagcgggtactgccgcttttataccgcggtctgcatgatgcgaatgcaagcgtgcggcggacggcaggcgactgtcttagcgatctcgggttcaaagaggcatgcggggaaatggcaaaagcgctcaaagacaaaagcaaaattgtcaggtggcgcgccgccatgtttttatacgaagcgggtgacgaagcttctctaccggctttaagggaagcggaaaacgaccctgaatttgaagtcaggctccaggtcagaatggcgattgagcggattacaaaaggcgaagaagcaaaaggctcggtctggaagcagatgacagaagcaaggcaaatccagccataattaaaggaggacatcaacatgtcaatggcatatgaagaatacatgcgggcgcttattaccccgatgagggaagaattgacggcaaacgggtttacggaactgcgtacaccggaagaagtagaggcctatatggaaaaagcggaaggcaccacgctggttgtcgtgaactcggtgtgcggctgcgcagccgggcttgcgcgtccggcaattgttgaggcaatccggacggctgaaaagaagccggaccatcttgttacggtatttgccggccaggacaaagaagcaacggcaaaaatgcgtgagtattttaccggcatcgaaccctcctccccttctgtggcgctgcttcaagggaaagaagtggcccattttatcccgagaagcgatatcgaagggcatgaagtcgaagaaatcatcgaaaatctgcatgctgcttttgaccaacactgcgcataaaattgcggccccgtttgcatcattccggttgcaaaatggggcctgttttttctgtgtaaatattatataataaatacatattcgaactgttgggatatggaggggatcacgtgaaaaactggctgaaaaaatcaatggttatccttgtttctgttttaacattcggccttgtccccccttcccatgcaatctggaatcatctctataaaactggcaatgaaacggcggaaacgacttctgcttattccaatcggacggctgccacaagccgcaagattgacagtgccgcgcttgctcggtcattcgttgaagatgcagaaaaacgggcttatctgaaattcggggaaaggatcaggcctgttattgaagacgagttccgtgctgccgttttgccaaacattcaaaccgccatcgcggaaacgctgcaggaatacccgcaggacaaactaccgctgctcgctgtttcagaccagccgagtgcgggaaccggtgaaaaaatgtttcatatttacaatacggaaacaaataaagacatcatccgtttccatgtccggcgcgaccatccgcccggcgacggctactattttaatttccattaccatgtagcctttgaccatttccaaacgcaccgccaccttggcaccatttactggggcaaaaacatgccgccgcaatggatgaaaggataaaggcgggttgaagaacgcttgtcgcggcagcagctgacagcgctgcaacggataaaagactaaagcggtgtggaagacggacacctcatccagtcgaacatttcatgcgctttttgcaaacgcagtgaatacagcaccggcagaaggatgtaaaatgagcgaaacatggcttctttgttgccggccgcaaaaaggaataattatgcaaatggatggttttgccccattgtaaaaactggatttcaatttatataacgcaattttccaggatagaaacccggatatttgaatgacaaaggatggaatcatgatgaaacaatatttagatctttgccgcgaagtgcttgaaaacggcgtcaaaaaagatgaccggaccggtaccggaacgatcagcgttttcggccatcaaatgcggtttcatctggaggacggttttccgcttctgacaactaagaaactgcatttgaaatcgattatttatgaactgctctggatgcttgaaggagatacgaatgtaaaatacctccaggaaaacggcgtccgcatttggaatgagtgggcagatgaaaacggcgacctcggcccggtttacgggaaacaatggcgttcatggcaaacccgggacgggcggacgatcgaccagatcacccaggtcattgaacaaatcaaaaccaatccggattccaggcgcctgatcgttaacgcatggaatgttggggagattgacaggatggccctgccgccgtgccattgctttttccagttttatgtggcaaacggcaagctgtcatgccagctgtaccagcgttcggccgatattttcctcggcgtgccgtttaacattgcttcttacgcgctgcttacgatgatgattgcgcaggttacggggctggaaccgggggactttgtccatacgcttggcgatgcccatatttacttgaaccatatcgaacaagtgaagctgcagctgacacgggagccccgcaagctgccgaaaatggttttgaatcctgaagtaaaagacattttctccttccggtacgaagattttacattaaaagattacaatccgtatccgcacatcccggggaaggtgagtgtatgatttcctttttatgggcggaagatgaaaaaggcgtgattggaaagaacaatgcgcttccgtggcatcttcccgaagacttgaagtattttaaaaacataacaatgggtcatccggttgtcatgggaaggcggacgtttgaatcgatcggaaagccgcttcccggcagaacgaatattgtgatgacgagagacccggattttaaggcccaagactgcgtcgttgtcgcaggcaaaacagaactgttaaaatgggcggatgcacatggcggtgagatttttgtcacgggcggcgcggagatttttgccctgctgcttgaggaagcggaaaaattgtaccggacgaaaatacatgctgacatggaaggcgatacctattttccgcctgttgactgggaggagtgggaaatggcttccagcacaaaagggataaaaaacgaaaaaaatccttatgactacgaatttcaagtatttgtacggaaaaggtaaaaaaccatggaaacactcccatggtttttctctgtgccatcagacataaaataaaatcgtgaagtacataaacgcgcttccggcaatgacaaagatatgccagatcgcatgggaataaggaaggtttttccatgtgtagaacacggcgcctaccgagtagcagatcccgcctgaaaaaaggagccagaatcccggagccgtaagccctttatacaaaggctcaatggcaatgaggatcagccagcccatgattaagtaaagcatcgtggacaataatttaaagcggtgaatgagaaaacattttccggaaatgccaatggcagacactccccatacgaccgaaaacaatacccatcccaaagtgccatgcagcgtaatcagcacaatcggcgtatacgttccggcaattaacaagtaaatggcagaatggtccagaatcgcgagaaatgttttcactttcgtccagtaaaagctgtgcagcagtgtggaaaacaaatacaaaagcagcatggaaaccccgaaaacaagaaaacttcctagatagagcgggttattcttttctgcggcgaaaacgacgagtataaccatcgccggaatgctgagcagaaaaccgatgccatgcgtaacggcattggccagttcctgtttccaggatgaaagcagtgttgaagttgtcaaaaatttaaaccaccttcgtctttaagcttctttttattatagggttttgcggggcaatctgcaatggaaacaacttgcgtctttagcgggtgcaattttatgcattcatcagcagaagatcccgtttttcatgttataatgggtacattgtaaattcagaaaggctaagtggtgacaaaaatgaaaaaatggttcattcctcttctcgcttccgttgcgcttgctttatcgggctgttcacacggcataaccggcctgttgtttaaaccggcaagcaacgaaaaaaagatggtgcccgttccgctgcacatcgtctcgatcggggactccctgactgaaggcgtaggcgacagcaaagggcgcggcggttacacctattacttgaaaaatgaactggacgccttaaagggtgtgaaaaaaaccaccattgccaattatggcgtaaaagggaaccggaccgaccaattgcttgcccggctccaggatgaaaaaattcggaagtccatcaaggattcagatgttgttatgattaccatcggcggcaatgatatgatgaaagtgctccgtgaaaatatttccaatttaaacaagcaggagtttgaggcggccattccagggtacaaacaacggctcgatcaaattttccgccgcatccgcgcgatcaatccggatgtaaagattgcgctcgtcgggctctataaccctttttcgaagtggctgaccgatataaaagaagtggaccaaatgcttgcagcctggaatgatgccagcaaagaggtggcatcgcgctataaaaataccatttttatcccagttgcagatatttttgagaacaacgaagatgaattgctttatgacgatcatttccatccgaacgatgaagggtataaacggatgtcgaaacggatttaccggtatctcctgaaagggaattttttggggattccaaaatagcaaagtggtaaaggaatgatgcttgcgtgaaaagaaacccatggaaaatcgctttttttgcactggcttcagtggttgtggcctttgtactcgtgctttccttctttctttttgtgccggatggccgcgtgcccaaaccggaaaaaaccggaaaaacgattgatttgcgggtagagacgaacaaggcggacttaacagcgctcattaaccgttatttgcgggaagaaaaaataaaagggaaagtgcttttaaatgatgaagtcgtctactatggaactgtcggggtcttttccgaaaaaatgcagtataagatgacgtttaagccgaaagcgttaaagaatggggatctcgttttaaagcaaaaatctgtatccctcggttccatccatctcccggtatcctatattttaaaattcgtcaaaacgacttaccacctgccgaaatgggtgatcatccagccgggcgaaaaactagtgtatgtccagctgcaaaatatgaagctggaaaacggcgccaaagtaaaagtcaacgaatttgatttgcagcatgatgacatctcgtttacacttggatttccaaaataacgcaaaaagccggcctttaaaagccggcttttcaatatgccacagaaggtttcgccgccgcctgtgtacatgatacggattttaaacgatcttgacgcggacgtaaacggcaccaaaacacttgtctgggcgcattacacgggttttaaacgatccttaaccctttcggataaaagtttttcaaaatgccgcccgcttctttgctccagccgagcggaaaaccgtccaccgtgatcaggacccagccgcgattctcgcttgttcccggcagtgtctccccttttaaatagcggatgcattcactgcttccggcgctaaggtccatccgatgtttgcattgtccggctttcagggaaagcgcgagcgcgtgattcggttcaaaccggttttttttgaaagcgccgagatgcaggccgcaccggacaaggcggagcccctttaactgcgggcagttaaagggcagcaggaaaagttcgtctttatacagaaaaaaggagcgcctgcctggatcaaaacgctggagggtgtttttggcaaaggttgtccagtctttttcctgttgctttgaaagcttcatgcccttttcaagcggcaccttttgccccgtttcccccgggtgtttgcgcatttttgcagcaaaatgtccttcgccttttaagcggtgcggccataaacgcgccgcattggacaaatctttccgcttttctgttgcccattccggctttcccggtccaacgccgtgttcatggggaatcggcaccagtgccatgtcttcatgccgcgccaaaaaagcttcaattgtctgttcgttttcttccggagaaaaggtgcaggtcgaataaacaagggtgccgccgggctttagcatcttccaggcatgctccaagatcgtgcgttgtttttgcgcgcacgcttcgacatgttcctggctccagaaacgcgcggcttcgggatcttttctgaacatgccttccccggagcagggggcgtcaaccaaaattttatcgaaatagttttcgaaatgccggctcagtttttcaggcgtttcgtttgtcacaacggtattggagaacccaagccgttcaatattttcagaaagcgcgcgcacccgcttcggatggatttcatttgcaagcagaaatccgttttcgccgattccagatgcaatttgcgtcgatttgccccccggcgcggcgcataaatcaagcactttatcgcctttttcaagtccgagctgccctgcgataaacatcgcgctcggctcctggatataatagagcccggcggcatggtacgggtgttttccaggcttgtctttttcttcatcaaaataataaccggaggcaaaaggaattttttccaaatggaaagggttgtgcgcatgccattccgtttcgctcacttttgtcggattcaggcgcaatccggacgcccgcggtttttcataggagcggaaaaaatcatcggcttcctttccaagcagcttccccatcttttccataaaggtttcaggtaattccaatcatgagacccctttccgttaaaatcgccgctatgatccattataatgaaatcggggcttgcagtcacgaaactggatgaaaacaacatcaacaggtaaaataaaaaataatcttttataaaggggggagccgcatggcagaggaaaccgcgatttttgccggcggatgcttctggtgcatggtccatccttttgaccaattgcccggcattcaaaaagtcgtttccgggtacacaggcggaacaaaaccgaacccgacatatgaggaagtgtgctccggtgcgaccgggcatacggaagctgttgaaattacgtttgatccggaaatttttccttacgaaaagctgcttgacatttactggcagcaaattgacccgacagatgcaggcgggcagttttacgacagggggacctcttaccggcccgttattttctatcaaaacgaagcccaaaagcaggcggcggaagcttcaaaaaaacggctagaagagagcgggcggtttaaaaagccgattgctgtcacaattgaaccggcttccgccttttatccggcggaaagttaccatcaggattattaccggaaaaatccgacccattacgaggcttaccggcaaggttcaggcagggccgcatttatccgcaaccattggagggatgaacatgaaggatgaaaaactgacgcctttgcaatatgaagtgacgcggaaaaacggaacggaaccgccgtttcaaaatgaatactggaacgagtttcgcgacgggatttatgtcgatgttatttccggaaaaccgctgttcagttcaaaagataaatatgatgcaggctgcggctggccgagttttacaaaaccgatcgatgccggccaacttaccgaacggcttgatacgagccacggcatgattcgtacggaagtgagaagcaaggcgtctgacgcgcatttgggccatgtgtttccggatgggccaggccctgcgcatcttcggtactgcatgaattcagccgcgatgcgttttattccgaaagaaaagcttgaggaagaaggatatggggagtatcttgcgctctttgaagaaaaagaataagccggctgggcggatgcacatacaaaacgggcccgtatcccatacgatgcactgtacagaaaaacagttttttttgaggagtgaatgggatgtattacggccatgaaggtgcttaccctgcatatgatccctgctgcggctacggatacggttatgggtccggttacggctggggctttgcaggacacagaaacggctttgctttaattgttgtgctgtttattttgctgatcattatcggcgcatgctggatcggccccaattaaaaaacggaaaaggcccggggcatagccctgggctttttcagtgtgtcttttatattttaaagtttccgatcagcttgcgcaggttttctgcctgttttgacaactccgaggctgcggctgtgacttcttccatcgatgcagacccttcctcggtacttgctgcggtcatttccgtatttgccgcggtattcatggcaatcttgctgacggcatcgaacgaatcggcgacatcgacagaaagtttttgcgttttttcaatttgggcggccatgtcaataatgacatttgtcgtttcattcgtttgtttttgaatgacttcgagcgagtgcatcgtttcattggaaatttgcacgccggaagtaaccgcctctaccccttcctgattctggccgataatggtgctaatttctttttggatcgaacgcacaatattcgtgacttcctgggcggcagactgggattgttcggccagttttctgacttcatctgctacgacggcaaagccgcgcccgtgctccccggccctggctgcctcgattgccgcattcaatgcaagcaaattggtttgtttggcaatcccggtgatcgtcataatgatctttgtaatatcatccgacttttcaccgagcgcctctaccgttttgctcgtatttgtcatgatcgcttcaatgctcttcattttgccggacgtttccataatggaccggctgcctttttctgccgattctttcatatggagcgaagcctgttttaccgtttccgcctgccggaaaagcgtatcgaccacttcttcaagcgacttcattttcgataaggatgtatccatcttggaagaagtttgttcgctgtctgccgcgatttcattggctgtttccgcaatcgactggatcgttttcgatgtttcttcagaagaagcgagcagttcttcgcttgaggcagagacactttccgccatcgcggatacttcttttacaagccgggcaatgccgtctatcagctggtttgtatctcttgccagttttgccagttcgtcattggacgtcacttcaatccgccttgtcaaatccccgccggcatctgcgattcccaaaatcgaccggctgatttttctcgtgctcgatttgatgtttttcgttaggctgatgctgagcatgacagccagcacgatggcaagcaaggaaagggtgacggttacgatccgcgcaatcaggacggaacgatgcaagtcgccgatccggctttctgatgcctgtgtggtgcttatcagcaaatcatggatgctgcttttcaaatttttcatgtagtcggatgcctgggaatccttcacttgtgcaaccgcttcttgttccgacccgtactgccttgcttcgacaacccggtcaactgttcctacccagaaattataggcttccgaaattttttcgagtttttggctctgcaaccggtcatctttcagcattttttgcaagcggcttaacgtgctgctggcttcctgtttcccctggtcatacggccgtaacgcagcttcatttccggaaatggcgtaattcagggcgcccgtttcaatttcgccggtctgattgagcaggctttggacacgatcgtgcacggcgaggtcatgctggacaacatgattgatttcattctccagctcgcgcatgtttatgtatgaagtgacggttaatacaatgagcaagacggttaaaaccccgaatgaaatcacaatttttcccctgatcgtctgcaaataataaaggggaagccgatgcagctggcggttcggacgggaatttttccgtttctcgcttttttgctttcttattgcaaaaatgttccttttattcaatcaaaagcccctcctttttaccctgtgaaccgcaaatcatcatctatattttaaacatgttttctatctttttctagttttttgtaaaaacttcctcttcccgtaatgccaccctttctactttacgcgggggagacgatccgctatattggagtaaaaatcattttgggggatacttatgaaatctttttaccagtttttaatgagatatagggatccgcatctccgtgacgagttgacggtttttgccaatggggcatacaatgatcacagttttccgaaacattcaaccaactatcatgaaatcagttcctatctcgaattaaacgggcattatatcccgtcaatgtcggtttttgatcgggcatgggagatttataaaggcgaaagcaaataaccggccgaaaattgtgctgttcgctttttccggagcgcatgcatagaatgaagtaaaacgtgtttcgttttcaaggagcatgaaaaatggatgcaaaagcgccgaagtttcaagttggagatacagtggtcgtaaaagtatacgggacggtgggaaaaattacggctgtgagacagctggaaggagggtatttctatgtggtcaatgaccgggaaggcctcctagccgaacaaagcctcgcccgcctggaagaatatgacgggattctgtataagaaagaggaagtcaatatagaattgaaattttttatcggggatattgtaaaagtaaaaggctatggcggcgttctttttaaaattgttggtttccgcacggagatttggcggtatgcagaagatgcatgggaagatgtgatttatgaaatggtcagcattccaaagggcgaatggcttgaagcggatgaagaagaacttttgttaatcgccgatgccgggcaggccgattcgtttgtcagccgttatcaatttttttacccgatgaaaagcagccccctgtatcagcttgtcacttccgacttgaaaacgcaggaaaaaatcgaccgcctgctcgatatgtataatgattatgcgctactgttaaacctgtttggtgatgaggcatacagggccatgcttgaggcggtcaaaatgcaaatccaggttctttcggcgcacggcggcccggattagtttagcgggtttggcatatcaggccgtacggggtcatatttatatcaacaaacagaacaaaacgcggggtggctgcgggatgaaaaaagggggcgtttttaatggagaatatggatgtttatattgatacagaggaaatcgccgcattcttttttaaagagctcgtgaaaaggggatttgcgccccgtgaagaagaactggacgaaattgccgatatcacttttgaatacttgcttgcaaaaagcatcatagacgaagaatatgaagacgattccatatgaggcgatctgtttgcaggccgtacagggaaaggtgcagcatcggtatccgggacagcctttttcggtcccgcacgaaatagcacttgatgtcccgttgaatttgccttaaaataaaaagagaaatcgcagggggagaaacctgcgattttttttggcaaaggagcgggatgcggacggttgtgcgcttaacgggaatgtgcttgctttttccatcgcagaaagatccggatggggcattcatgccgcttcttttgcagttccggctcaaaatgggggcgagcatccattttgggacagaagcccatgccgcagtgaacgcggtaccggtagaaggatcaaaagcacaaattttttaggatagagaaaggtgacaacatgagaaaatatgtatataccggccttgccgcgatttttttggccggctgcagtgtaacaaacggaaaccagccggaaacgggcgcccataaaagtaccgcgccggcgaaaccggcccacacggataccgcgaaaaaaaccggttccggtttggtgcttgatgcaaaatattttaacaaaatcaaaacggttaacgggaaaaaagtgatccagaatccggacaatattttggcgcttgtcaataaaaactatattctcggggattacaaaccgaaagacctcgtccggccgaatgtccgcttttcatttggcgacgaaagaatcgaaaaaagctatatgcggaaagaagcagccgcggcgcttgaaaaaatgtttgccgccgccgagaaggacggcattgaattatatgccgcttccgcataccggtcgtataaccgccagaaagctgtgtatgcggcagaagtgcaaagttcgggggaagaacatgcagaacaggcggttgccatcccggggtcgagcgaacatcagaccggtctcgccgttgatattacaagccagaccgcccatttccttctctcacagcaaatggggaagcagaaggaaggcatctggcttgcaaaacatgcacatgaatacgggtttattttaaggtatccgaaaaacaaagaaaacattacgaaatatgagtacgagccctggcatttccggtatgtcggaaaagaggcggcagccgtcatttacaagcacggctggacgcttgaagagtatttcgaacatgtacataaggctgaataaatcctgggctcttttattaaaaagaaaaagctggtagaataaagaagttagaaatcgggagctatgacttttggaaaacggcatgaaagtggtgaagcctttggacgatgagaaaaaacagacggaatccggccaggaagaacaaaccggttatatccgtatgaaaaaatttaaatttgtcatgcttttgtttttcgtgattttcataacagccggcattacgaccgctgcctttgcgttcggcgaccaaaaagccgtcaacgtgacgactgtcaaccggccggagtttgacaaactatataaagcatatgacagcatccagaaaaaatattacacaaaagtaaaacagaagacgcttgtcgacggggccattaacggaatggtggaatcgctcaatgacccgtattctgattatatgtcaaaaaccgaagcatcagacttcaataacaccatttcttcttcttttgaaggaatcggtgcggaagtggaagaaaaagacggctatattgtgattgtttcgccgattaaaggttccccggccgaaaaagccggcctgaagccgaacgataaaatactcgcggttgacggcaaaagcgtccatggcatgagcgccaatgaagcggtcatgttgatcaggggcaaaaaagggacaaaggtgacactcacgatccagcatgtcggatcgaaagacgaaacgaaagtgaccttgacacgcgacacgatcccggtcaatacggtttatgcgaagatgttgaaaaacggggttgcccatatccagattacgacattctcagacggcacatataaagaattcaaggcggccgttgagaacatgaaaaagcaaggaatgaagtcgatgattgtcgatgtgcgtcaggacccgggcggattgcttgaccaggctattaaaattgcgaatatgtttgtgccggaagggcgtacgatcctgcaaacggaagaccggaacggctcccgggagaaatatgtggcagaaagtggcacgaaaataacggtcccggcggttgtgatgatcgacggcggcagcgcgagcgcttctgaaattttggcggccgcactgaacgaatcggcaggcattccgcttgtcggcgaaaaatcatacggcaaaggcaccgtgcagtctgctgaaaaattcaacgacggatcgattttaaaattcaccgtccaaaaatggctgacaccaaatggcagctggatccataaaaaagggattgagccggatgagaaagtgtcgcttccggattatgccaaacttccggtgatcggaacagatgcagaattgaaactgtattcggtctcggaagatgtaaagacggcggaaaaaatgctaaaagcactcggttacaatccgggcagggttgacgggtacttcgactggaatacaaaaacggctgtcgaagctttccaaatgcatgaaaaaatgcagccgacaggcatcatcaatggcgatacggcaacaaaactgatgtctgaaatcagcaatcttattacgcggcatgatacgcagctcaaaaaagccgaagaagttgtccaaaaagaaaaatagcaaaataagccgggagcaaatctcccggcttattttatgcaatcccatgcacgaaaaatgatataataaagtcaggagattcgctgtcccatatgagaaaggaaaggaatgggagtgttggagacaaaagatacagttgatctggaattcatcttccgtagaatataccgaaaaattaaagaagaactgcatagcttgttaaaagagcatgtgacgcttaacgaatttatggtgttaaaacttttatcggaatcttcgatgcgttcatccgatttgtcgaaaatactgcaagtttccgccagccatattacttctgtaaccgattcactcgtggaaaaagggctgattgagcggaaaagatccaataaagacagacgtgtggtcgatttaattttaacggaaaaaggaaaatcgttaatcagtcagttgaaagaaaccaaatctcagtttctaaaagaccagctgaacgtttttacggaagaagaacgggaaacattgtacaggctgttccggaagtttgaagatcgcctcaatcaaatgcactgatatgaaaacgcgcccatatacacaaaaagcgccctgaagccgcaagcccggcttcggggcgctttttttaaatgaatgtggcagcatgcaacatttaagaaaaaaatgtaacaatacccgcccgttttccgccttgtcaaccctgaaatccttccatcttttggatatttaaaaagacggtgccaatgtgtgaaatgataggaaattcgcacgatgcatggaaacctttgatacagctggctttttcattttcagtttgcaagcaggcccctgctttgctgcttgttctattttctcccagaaatattacaaaaatcgtatgttatgattctattgtgtacgagagagaaaccaacgaaaacgagggaggacatcattgatgaaaaaggccatgttcacaacagcagcagcacttgcactgatccttgcaccggcagtttccggcaaggcgggggcagcctcaaacgaaacaaactgcagcccgaaaacggttgttcaacatgaatacaagtttcatagcatgcaggaattggagaactggttaaagcagcataacatccgtttttcttttaaaccggcaaccaatcaaacggcttcaaacaacgcaggcaaaacgaaccagacaacggcagcaccaaagcaatcggcaccggaacaaacagcagcaccaaagcaatcggcatcaaaacaaacttcaacgcaaccggcaggcagcacgcagtcccaggctgccaacacgttaaacgcctatgaaaaacaagtggtgacccttgtaaacgaagaacgggcgaaaaacggccttggcgcgctgaaaattgatacggctttgagcaaaatggcacgcgtcaaatcgaatgatatggcaacccataaatattttgaccatacaagcccgacttacggatctccgttcgatatgatgaagcaattcgggatctcgtatcaatatgccggtgaaaacatcgcaatgggccagcaaacaccgcaggaagtcatgaatgcatggatgaacagcgaaggccacagggcgaatattttaaataaaaacttcacccatatcggcgtgggctatgttgaaaacggccattactggacacaagagtttattggaaaataaattgcttatcgcagcctcttttacgggggctgcttttttgtacgcactttttgaaacgtcacttgcggaaaacgggtccactttcctgcaagctggtccatctgccggatgtgccccgcttgcgccaaaccttatccattctttttcagcaaatctccggctttttgctggatataatgcaagcgccctaaaagtgttaccgcacctacagcaaggcctgtgatcagtccgatccagtaggcaaacgggccgagggcggtgacggcatccagcaaatatccgagcggaagcccaataacccaatatgaaacaaacgtcataatggtcgtaatccggacatctttataccctcgaagcgcaccttgcaccggcgcctgaaccgcatctgaccattggaaaaagatggcatacagcaaaaaatgtccggttaaccggatgacagccggatcatcactgtaaaacgctgcaacttgttcatggaataagtagagcaacagcccggtcaaggtggcgatcacaacagcggttataagcccgattgtgctgtactggcgggcgtcttgaaatcttccggcccctgcttcaaaactgacaagaatcgtcattgcaagcgaaatgctgagcggaagcatgtacaaaagcgattcaaaattcatggcggcctgatgggaagcgattgtgtcagtgccaaatttgctcatgaacaatgtcacaaccgaaaaaatgcttgattcaaaaaaagtcgacaaccccatcgggatcccaagcgccaacagcgctttccagctgcggaacgaaaccgggtaaaacgtgcggaacagccgcatttcagcaaaacgtggcaaacgcataagcacaaggattgcaatcaacaagataagccagtaggtgatggcactcgcaacgccggcacctgccccgccaagctgcggaaatccggcatgcccgaagatgaacagaacattcaatccaatattgatgggcagcgccaacagtgtgatcaacattgatatttttgtcagcccggttgcatcaatcagcgagcggcaaacctggtaacagaacaacggaatcagcccgaaagacagggcaaataaaaaccgatgcgcgaccctctccacatgcggcgctaaatccatccggccaaggaccggcccgatcgatagcccgcctgcaaacagcaccagtacggccatacagacggcgacgtaaaggctctggataaatgtacgggggatttcatccgtgtttttgctgccgatcaaatgggaaatgatcggggtaaccgcctgtaaaaccgttccaagcccggttgaaacggggaaccagagggatgcgccgatcgcaacaccggccagatcggctttggaaaaatggccggacatcgttgtatcgaaaaaattcatgagcagcatcgcaagctgggtgatgagaatcggcagaaataaatgccaaagctgtgcgattttttcttttaaggtaaaggtttgtttcatgttcattcccccaacttttccacggactccaaaaaattataacatattcatttttcgggccgccatggatagcctgccatgaagatggaaatgcccggcgaaagatttgcaaacccgtaaaaccatcatgatttataaaaagtctcatataatagagtgaccagacaaaaacgggagagtctgtatggagctgaaaaaaacctattcgacgttgtctcacatgtacctgtgtcaaaccgttattcttgcatgcggcctttccgcattttgtctcacgctgatgtatatcgggcgcggcggcatgttcaactggctgattttggccgtctggctgttcattctctactttgctgcgcgctatttctactatcaaaagatagaagaaaacatatccggagaaaaaggggaggaagaaagacaagcggacagcgggcagtacttgatccagtttccgcccggtgcaaaactctcggtgcagctttatgatggaagcggccgcttagggtggctgcttgaggaaaaagctttcagacaacaaatccggtatttccgccttgaacggggagcgggcgccacatttagcgccacggtccgcaaacggcaaaattgggaaatcagcatcgggtttccggcatatgaacggttcttttcattaaaaagagcaaagggaaaagaaatgatatttgaaaacggcagccggacttgtgcgatccggaaaaatggaaaccatgatttggaattttaccgggacgaacaacttttagcagtggtgtcacgcggcgtgatgccggtaagctggcagcagaagtttccgcttaatgcaccggtacttacttttatacgggggacggaagaagacgaagtactcgtcatcgcactgctcgcctttttttacaggcataataaatatttcgtgtaaaaaaaaagaagaaatgatacaatttttgtaagaataaagaaagaaaaagagaggaaatccatcatgcatgtgaaactgattaaatgccacggctcaggcaacgattttttgctgatcgatgaaacggaaatctctgcgccattaacggacgacatccgcaaaaaaatggctctgtcattttgccggcgcgatgccgggctcggggcggacggcctgctctttgtgtcggaaagccagcaggcagacgcaaaaatgcgggtattcaatgcggacggttccgaggcgtccatgtgcgggaacggcctgcgctgtgttgcgcggtacgtatccgaaaaacgcgggaaagacgatctgttaattgaaacgatgaaagcaaatctatatgcccgcaaagcagagcccctattggacggcatcccaacgttccgggtcgaaatctcgcctgtctcctttgacttgaacaaactgccgatgcatattgataaagaagtgctcatcaatgaaccggttaaggccttgtcggaagatttgtcgtttacagcagttgcggtgccgaatccgcatctgatcgcctttgtcgaaaatgaaggattccggtctgatacgcaaaaaacattgtccgagtatgtgaacggaccaaatgatatctttccggacggcgtgaatgtcagctttgccaaaccgattggtgaaaatggcttatacgtccgcacgtttgaacgcggcgtcggttttacaaatgcgtgcggaacggcgatgtccgcttcaagccttgtggcctgcctgttaagattgcgcccgttcggtgaaatgatcgacgtgttcaataatggcggtaaagtacggtgctttgtccaaaaaattgaaaaagaaggggaaccggcatacacgattgacctgatcggtaatgccacctatttatacgaaaccgctgtttcttttgacgatgggcacccggaacagttccggattgcagaaaaaaaggatttcggcgaacagaagctgtatcaaaagctcgaaacccatgcaaaagaaacggtagagaaagcattggcttaaaattttcgtctcctgtaaaagggaggcgtatttttttcgattggaaagctgcgccaaactatatggggcgccctttgttctgctttaaaaatgcaagtaccggggcaaaaggctggccgcttttgcaggcaaagaatcgcgcaaacgggcagccgtaccggttcacacgcgaaaggaccgtttcaatggtaaagtcatacggcgaaagcgacgcgtttacttcttcccagaaaagcggcgccgccacaagcgcatcctcatgcccgcgcatcgaataaggtgcaatgatcgtttttccttccgcatgctggacgaaatcaacatataattttccgccccgttttttcttcatccgttcgattgtaaaatgttcaggcgatttcgaaatgaaataagcagccataaattccgtgaacagccttgtatcttcccatgagaactgcctgtccggcaatggaatgtagacttgcagccctttatttccagaaattttgacaaagctctccaaatgaagggcatccgtcacctgttttaacagcaaagccgcttctactgcaagttgaaacgcatcccgggaaggggggtcaaaatcaaatacaatctcactgacgaaacggctgtttacggtctgaaacgggatatggtattccaccgctagctggtttgcgagccacatcagtgtttttaaatcgttgcagacaatataccggatgtcttcatgcatagccgtatccacaaaagcgggcgcataatcggggcagtttttctggtaaaatgcctcgccgaagacgccgtgcgggtaacggatgacggtcaaaagcctgtccgaaagaaacggcagcataaaaggagaaatttcccgcatataggcaagaaagtcgagctttgtcacatggcgctttttccatagcggtttatccggatgcgtcacttccacttcttccggaatggcggcgttacggagcctgaaatcttcaaacgtgcaggcatccggcgaaaggtcaaagcggaagcggtggaaatgcggttcccgcagattggcgccgtcccattccaaataaaatatctcgacgcaaatcgaaggatcgatcgtgtagacgccgttttcattgtttgtggcatttttcctgaccgcttctgtgaggatttgtttttcgtccggattcatgctgaaaagaaactggccgattggaaaaatgtcgccatctttaaacactgcgacatcgaaatacccgtttttctcgtcgtaagccgtaataaagcaggcggctgtcttccaatttttcacttttatccatgtttcaactcgttttcccgcttcccacttgctgtccgtttgttttgcgacaatgccttcactgttaaaatttttcaccgtctcttttaagacggatgcgtcacgggtgaacgggatttgctgaacccgtgccgtttcgcccggggcgggggagagcggcagcgcgagcgtttcacataagttttccaatgctttttttcgctgcaaatacggtttgccggccatatcctctccaccaagcatgagcaaatcaaatacgagataatgggcggggcgcattttcgcctgctctgcagctgcttcagctttcatccgcccgcggcgttgcagctccccaaagccagctttatacggattttcaagcagcacaagttcgccgtcaagccgtaacggaagctgcccttttacacggccttcaagcgtttgcaaaaaggtgcggatttccggaaaccggggcagcaaatctttttcgttgcggctccataaccgcatgccgtcttctgtccagtcgaggatcgcgcgataaccgtcatatttaatttcgtatacccactttcctgtatctggcagagaccattttaaaaccggcaacatcggtttcatttcgagcaccctttctttttccaaaagttgaagtacatagcggggtggattcgtacatatattatcttcaaaaagcgaggcgtttcattcatgcatacgatgtggaaaggcacgatcagtttcggactcgtcaatatcccgattaaactgcatgccgcaacggaagataaagatatcaaattgcgttcccttcataaaaaatgccattccccgatccggtatgaaaaggtttgtccggtgtgcgaggaagaattggacgcaaaagaaatcgtaaaaggatacgaaatcgcgaaaggaaagtttgtcgtactggaagaggaagaactggaagaactgcgcaaacagacagaagaaaaagcagtggaaattatggattttcttgatatgcgggagatcgacccggtctattttaaccggagttattacatgtccccgaatgaagggggcgtaaaagcttacggcttgttgcggaaagcgctgaccgaatcagagaaagtcggacttgcccggattgttatgcgttcaaaggagcagctcgccgttatccgcgtgtatgaaaacacgcttttgatggaaacgatccattacccggatgaagtccggaaagcatctgacgttccgaatgtgccgcaagatgatgaagtctcgaaaaaagaaattgagacggcaattttgctgattgatcagttaacgacatcgtttgagcctgaaaaatatacggatgcataccggtcaaacctgatggctttaattgaatcgaaacggaccggaaaaaaactcgtcacggcaaaagtaaaagaaccggaaaacaatgtgaccgacctgatggcggcgctccaggcttccattgacagggcaaagccggcaaaaaaaccggcaaaaaaaccaaaaaaagcggccaaaacaaaggcaaaagaagcgtaaaaaccgggcggtaccggatagcacggggaatgccggaaaatttgccggaaagcctccaatatggtaaattatttcatattggaggttgatgatgaaaaggcagacgattgtgcaatggctgttcgttttactggtgctttccttctgcacctggattttttttgaaatcgccggtcacttcaaccaggcggagatccggcattttgaccttccgattatctcatttgtccaggggaatatttccggccggctaacgagcgtgatgctggctgttacctttctcggatctgtaaaaggggcggcggcggtcaccctctttctttcccttgtgctctggatcaaaaaataccgtacactaagcctttatctcgctgtatctgtcgcgcttggagccggggtttttaacaccatattaaaatacatattcaagcgccagcgtcccgatattatgcgtgtcgtccaggaaacgggttacagcttcccaagcgggcattcgatgggatccatgattttatacggctgcctcgtattgatcctgttccgcattgcgaaacgccggtgggtgaaggtcgcggggacgctgtttgcccttttattggtgcttgccatcggcattagccgcatctatttaggggtccactacccgagcgacgttgccggaggatatgcggccggccttgtttgggtcattttatctgcgcttgcgttgaacttgtttgaaagaaaattgaaattgtaataaaatatggtggaaataaaaatatttggcggtgggtatgcggaattccggcgcggacagccccgcttggccggaaagggctgcccaggggctggaaaagccgttgatgagcgcttgcttttttttaaaattgtattacaatatgttggtatgaataaatgaagcgtcctgaaattgttgccggagagtttggcaattgggagggaatactgaatgaagatctcgtttaaccagattaaaagtttgctaaataaaaaatacgccctgtactttctcatggttttattgttctgggtaaaaacttatattgtctataaagcggaattcaatctggatctgcaaaacggcatgcagaaatttttgcttgccatcaatcccatcagctcggcactgttcttctttgcgcttgcgcttttctttaagggacgcggccggatcattgcaatgactgtgattgacgtgcttttgtctgttttgctgtacgcgaatgtatgctattaccgtttcttcaatgacttcattacgctgccggttttgtcgcagacgaaaaacttcggcgacctcggcgggagtgcagctgcattaatgaagccttatgatattttttacttttttgatacgatcatcctcattgccttgattgcaacgaaaaccgtcagggccaacgcagggaaaatcaaccgccgctcgcttgccgggctgatgattgccgcgattgcatttttcatttttaatctcgggcttgccgaagcggaccgcccgcagcttttaacgcggacttttgaccgtagctatatcgtgaaatatctcggtatgtacaattacacgctttatgatgcgatccagacaacaaaatcgtctgcacagcgggcgatggctgacagcagtgacgtgagcgatgtggaaaactatgtgaaagcgaactataccgagccggacagcaaatatttcggcgcggcaaagggtatgaatgtcatttacgtttcacttgagtcgttccagaactttttgatcaattacaaattggacggcaaagaagtcacaccgtttttaaactcgctgacaaaggataaaaacaccttttatttcgataactttttccaccagacaggccaggggaaaacgtctgatgccgaatttatgatggaaaactcgctgttcccgctgccgacggggtctgtatttacgacgaaagcacaaaatacgtaccaggcagcacctgccattcttggccagaaaggctatacatcggctgttttccacggaaactataagactttctggaaccgtgacgaaatgtacaaatcgttcggctatgaccgtttctttgacgccaagtattacgatatgagcgacaaaaatacgttaaactacgggatgaaggacaaaccttggtttaatgaatcgatgcagtatttgaccaaattgccgcagcctttctatacgaagtttattacgctttcaaaccacttcccgtttccattggatgaagaggatgctgacttcccgaaaggcaatttcggtgataaaaccgttgataactatttccaaaccgcccattatctggatgaagcgatgcagcagttctttacctatttgaaggaatccgggctttatgaccataccgtgattgtcatgtacggcgaccattacggcatttcggaaaatcacaatgcggcaatggcgaaagtgctcggtgtccctgaaattacgccatatttgaacgcgcagctgcaaagggtgccgctgtttatccatgttccgggcgtaaaaggcgggatcaagcatacgtacggcggtgaagtcgatgtaatgccgacggtgatgcatttgcttggcgttgatacaaaagactacatccagttcgggtctgatcttttgtccagccagcatcgccaagttgttccgttccgtaacggcgattttgtcaccaataagtacacgcaagtatccggaacgctttacgacaatgcgaccggtgaaaaagtcaatccaaaacttggcaaaaatgatgaaaagattgcaaaagagatgctgaatctgtctgataaagtggtatacgacgacctgctccgtttctacacaccaaaaggttttacgccggtgaaccggaacaagtatgactattcctttgaccagacggatatggccgggttgccgaaaacctccattccggattcagccaaaaagaataaataaagaaaacaaaccccggtggaatgcaaccggggtttgttttttgtgccaggaaaaagcatatcgtgaatgcatcattccggcttcttttatggttttcaacaggcatgttttcaatcattttttaaagagcaaatccctggcagtttgaaaatcatttgtcggttgattgcagctgaagttttcacagacataaatggttggttgcccgtttatcatggcataatcttcaataaaaggggcgattttggagagtttcttcttttcgcgcctttttactgccatgaaggaaatttcggggtgaaaattctcctgaatatggcggataaaatcaacagctttttctgtttcatcatccataacgatcaccacttccttcgttgcctgctgtgcgtacatcactgcctgcatcatcatggcgtgggcattgggatcatcatggataaccttgctgaaggcctgaaacatttgctggactttttcttccaacgtaaaatccccggtcagtttcgccagccttaacaattggcaggctgcgacactgttcccggaaggcagtgccccgtcataagactccttttgcctgacgagcaatggctcatcgtcgtttccgctaaagaaaaagcctcctccatgtccgtcccaaaataaatcaatcatattgccggccagtctttttgcttccgccaaataaaaaggggcaaaagtggactcatacagttccatatatccccacaggagaaaggcatattcgtctataaaacctttgttttttacttcgccatcgcggtatcttaccattacccggccattttggatcaagttgtcccttataaaagaaaccgctttttctgcagcctgcacataagatggttgataaaaaacacgccccgcttttgcgagtgctgcaatcattaagccgttccatgccgttaaaattttatcatcgcggaacgggcgcacccgtttttcccggtgctggaacaagctttgccgtgccgtttctaatttttccgccagcgctgcaggagaaaacccttccttttttgcaattgtttccaaatgggttgtaatctggttcggaatattttttccttcgaaatttccctgcccggtaatgccgtatgcctggcaaaagagcgtgcccaactgttcccccagcacatcttttacttctttaggcgtccacacataaaactttccttcctcgccttccgagtcggcatcttccgcggaatagaatccgccatccggatgggccatatcacgcagcacatacttgatgatttcttccgttatttttttgtaccgggcatttttcgtcatccggaaagcatcggtataggccagtgcaagcagcgcattgtcataaagcattttttcaaagtggggcaccaaaaatttttcatcaacggaatagcgggaaaaaccgtaaccaatatggtcataaattcccccgcgcgccagcccgtccaatgtttttgttgccatcgcaagcgcatcccggttttcataaaatttggcatacatgagtaaaaatacaagtgaatgcggcattggaaatttcggcgccttgccaaaaccgccgtagcggggatcaaaagcctgcttgtaagtttggaaagcgcgcccggtcgtttctttcgttaaagccgtttgttctcctttttcccggcttgcctcgagcgcctgtttgacttgtgcccccacatccttgatccggtccggattttcggtgtattgttgggataaataatgcaacacttctttaaaaccgggcatcccataccggctttcccgcggaaaataggttccggcataaaaagggaccttctccggcgtcaaaaatacgctcaacggccagccgccctgcccggtcatcatttggcaaacaagcatataaatggcatcaatatccggccgctcttccctgtccaccttaatcgccacaaatttctcattcaggatccgcgccacctcttcattttcaaaagactcccgctccatcacatggcaccagtggcaggtcgaatagccgatggaaacaaaaaccggcttgttttcccgcttcgctttcgcaaaagcgtcttcgccccacggataccagtcaaccggattacgggcgtgctgcagcaaataaggcgatttttcatgaattaaccgattgaatggtctgttttcacccaagacattcccttctttctttcaattcctttgtcatcagtttacctgaaacaaaaaggcgctacaaatgcttgaaatcgcacggctccgcaattaagcaggggaagaggcttcagcacgtgatttgtccggtttcaccgccgcaaatgtaagccctgccgccaccaggcagaaaccggccatgatcaccatgctgatctcaactcgccctttcataaaattggccataaataacgggcctgccgccacgccgatatagcgcatcgaactgtaaatggcgctgatcgtcccgcggacttctttttcaatcgactggttaatcagcgcatccaacggcgtaagagaggcaccgattccgattccgcaaatgagaaaggtccccattaaatagaaaaaacggtccgaaaaggagatctcgagcacggaggctccggtaataagcacactggagaaaataatccatttcatcagtaccatgttttctttaatgattttccctgttataaaggaagaaaggcacagcgccgcaagcgggacggccaaaataaaccctttcttcacgccgtggtagccgtactggtcttccagattggacgacaaataaaacagcaccgcaaacaaaataaacatcacgatggccccgatcgcaaatacggacgccagccagcgccagtgctggcggaacacctttttcgtattcgatataaatgctttgattcccggaccctgtttttcttgtgccggccttttgacaagaaacaaaacagacaggatagagatcaggcaaaagaccgggatggccgcaaaaggcaaaaaccagatcaaccctgccagaaaggatccgagaatcgggctcaatacttttccaaatgtattggccgtttcaataatgccgagggtggtgctcacatcccggttgcggcggaacatatcgccgacaagcggcaatacgatcggtgccgcgccggccgtcccgacgccctgcaaagtccggccgaccaaaataagggaatacgggtgatcgagttgccaggcagcatatgccgaaatcgcccctccggcagccgtaatcgcaagtgacgggataatgaccatttttcggccgtatctgtccgataaaaatccggcaaccggaataaggaaaatggcgacaattgaataaaaggtgataatatagctggattggactttggtgatgcccagtttgtcctccatgaggggaaggaccggaatcaacattgaattccccagtgtcataatcaggggaatggacgataatgcaacaatcgcccatcttttttgatggatttcattgtttttatcggataaaggtgtgttcgttgtcaaatgatccattgtctgtattttcctttcttcttctcaatgtcagcactcttctttactatctgcccaaccgaagacatttatgaatggaaaaaacgggttttctttctcatcattttttaacaaaccattcatatctttttcttttcattcggttagcatataagaaaaagcggattctccttgatcatgcgctgtccggagctataataagggcagcggaaaagaaagagttccggcaaaagaacttcgagggggaatcatcatgaaacggatattactggtagaagatgaaaaaaatctggcccgttttattgagctggagttaaggcatgaaggatacgaagtgaaagtggcgtatgacggacgggaagggctgcagtcggctttggaggaggactgggatgtgattctccttgatttaatgctgccgaaactgaacggccttgaagtatgccgccgcttacgacaggaaaaagaaacaccggtcatcatgattaccgcccgggacagcattatggaccgggtatccgggcttgaccacggggcggatgattatattgtcaaaccatttgcgattgaagaattgctcgcgaggctaagggccattttcagaaggatggagtacgccgagccccaaaaagcggcgctaacaacgtacaagttccgtgaccttgtgctggaaaaagaaagccggcttgttaaaaaggcaggaaaaacgattgaattgacaaaacgggaatacgacttgctgcttacgcttttggaaaataaaaatattgtcatgacccgtgaagcactcctgaacaaagtatggggatatgaaaccgaggtcgaaacgaatgttgtcgatgtgtatatccggtacttgcgcaataaaattgatacagaaggcgaagacagctatatacagacagtgcgggggacaggatatgtgatgcgcgaatgagagcggtaaaacactggctgcaaaaaagttccttgaaagtaaaatggtccgttggcgcaagtattgcgatctttttaacgtttctgattttcggttttttccagtatacgctgatcagcagatggcttttgcatgaagaggcgacttcggtgtccgaggcgctggatgatttgaacaacaagggggaaaacatcgatgacattttatcgaaccggacgctctttcagcaggtgctggaaaaagaccagtcgatccggattatcaatgcggacggaaaggaaatgcttgtcgtaaaaagcattcattccaccgatgcaaaagtgccgtttgtgccggtgaacgaaaaacgggtcagcctgatccgcgcgggcaatcatcaaattttagtcggaaggagcccgttccgctcccaatcgttcaacggctatattgaagtgatctatcctttataccggtatgaaaatttaatgcggaatgttctgtttgtcatgatggtcgccggatgcgtgggcttgcttttgagtgcttttctcgggtttatgatggcaaaaaatttcctcaaaccgctgaaaaagctctcttccacgatgcaaagcatccgcaaaaaaggattccaagaacggatggagccgagcgcctctaaagacgaaatgggggaattgaccaatatttttaacgatatgatggaccaaattgaacagtcgttccggcagcagaaacggtttgtcgaggatgcttcccatgaattaaggacccccgtccaagtgatggaagggcacttaaatttgttaaaccggtgggggaaaaatgaccctgcgattcttgaagagtcgctccaggcttcgctgcaggaattaagcagaatgaaaaaactggtggaggaactgctcgatctttcgcgggcggaagaagccaaaatattggccaatgaggaaaaagcagatcttttggcggtcacagaaagggtgatccgcaattttaaaatgatccatcagcagttcgacttcaattttcaatatgatcccaatcaggcctatgacatccaaatgagcgagaaccatcttgagcaggtgctgatcattgtatttgataatgcgataaaatattccgaccgcatttataaagtcgatatccgcctcaagcaggaaaaggggagggccatgttaacggtaaaagattacggcatcgggatcccgaaagaagatttgccgcaaattttccaccgcttttaccgggtggataaagcaaggagccgcgcaaaaggcgggaacggactcgggctcgccattgccaaacaactgactgaaggatattccggcacgatagaagcagcgagcgaggttggtaaagggaccgagatccggtttacattcccccttgtcgcaaaacaaaaaacaggtggaaaagagggcgtttcgaaaaaatgaaacgttcttttttctttttaaagaaaaggtgcagggccgtgtctggcaaggtgcccgcctttcgcccgtgatgggtaagtcttttgatacgcaaaaaaacgggaactgtcagaaccaactgtaagttttatcgagaaggcagagccgttaaaaatcaatgccgacttctgtcatttcatgttcgctttttttcaggagccggatttccaggatgccatcccggtattttgcggtcgtccctttcctgcgtaccggggaaggcagccgtatcacctgttccgagtccggttttggaaatgattttaacatgacttgaagggaagtgtggaagatttttaagcctgtgagcatgctttcctcctggatagggacgcggataaaaataaaatccagtgtttcaaatatttctatagacggggcgcccgtatccggggaagagggagccggatcatcggccccgtccccctttttgaacgcggcgccccattcgtcccattgagaaagggcttggttgatatgttcctgtacaggcggaaacggcatattcatcatcttgaagatctcttcggtgaacggaaacgttttccatgggaacatttttctgctcctttctgcaacggggatataataaaatatgcggttttgaacaatcaggtgaggcaaatgcagcatcactttccgggaaaaaaacagaatgaatcactattcatgcaaatttttaaaaataagagtttttaactttatctattacgcttacagtgctaaaattgagtttgtaagcgttacagctttcaaaattctttatcgttacataatttcatggttccgttttggtatccgccagacgaaatcatacgaaagtgaataagggacgaagggctggaggtttttcaaaatgaatgcaactacaccaaagggattttgggaaagtttttccgggcctaatcttgggtatgtcatggatttatatgaacaatacctggaagatccggagagcatcgacgaagaggcgagaaaagtatttgaccagtggggcgcgcccgctgtttccgaaggcgggagcccgacacaggggcaggcggatatttctttccaattgccggcaaacccgacgattttcagcaaaatggtcgctgccgtcaaattggcggacaatatccggacttttggccatctcgcagcggatatcaacccgctccaaaaacctgttggggatgtcagaagaattgaactgggagaatttgatttaaccgaagaagatttgaaaaaagtgccggcatcctttatttgcccggatgcacctaaaagggtcaaaaacgggcttgatgccatcaattatttaaaagaagtgtacacccaaaaagttgcctttgagtttgaccatattcacgacatggaagaaaagcactggctgcaacggactgttgaatcgggcagctttttccgcgaactcagccgggaacagaaaatcggcattttaaaacgcctttccgatgtggaaggatttgaaaaatttatccaccggacatttgtcgggcaaaagcgtttttccattgaagggcttgatgcgctcgttccgctgatggaacaaatgattattgaagcggtaaaaacaggtgtgaaaaccgttaatatcggcatggcgcacagaggccgcctcaatgtgcttgcccatattcttgaaaaaccgtatgagctcatttttgcagaattcaagcatgcttccaataaagatttaatcccttccgaaggatcgatcggcattacgtacggatggaccggcgacgttaaataccatctcggtgcggacagaaaagggcaaaacggcggaccgatcggcgcgcgcatcgtacttgccaacaatccgagccatttggaagttgccgatcctgttgtcgaagggtatacacgcgccgcgcaggataaccggaacaaaacgggctatccggaccgcgatccggaccgcgcctttgcgattcttgtccacggggatgccgcatttgcggggcagggcattgtcgcagaaacgctgaacatgagcaaactgaacggatacgggacaggcgggacgatccatatcatcgccaataacaatatcgggtttacgaccgaaacgtatgactcgcggtcaacgaaatatgcttccgatccggcaaaaggttatgaagtgccgatcctccatgtgaatgcggatgatccggaagcatgcgtacaggcggcgctgtttgcgtatgcttaccgcgaaaaattccataaagattttgtgatcgacctagtcggctatcgtcgctatggccataacgaaatggatgaaccgatggtaaccaacccggtaatgtaccatgcagtgcacaatcatccgacggtcagggccatttacggtgaacagcttgcaaaagaaggcgtcctgacagccgaagaggtcaaaaccatcgatgaagccgtccagaaaaaactgcaggcggcttacgaaaaagtgccggacggcgaagcggaacccgatacggccatggaaccccctgaaaatgtgaaaaaaggttatttgagcatggaaacaggggtgccggaacaggaactgcgggcttggaacgctgaattgctcgcctggcctgaaaacttccatgtctttaaaaaactggcgcggattttgaaacgccgcgaacacgtctttgacggcaagggaaaaattgactgggcccatgcggaagcgctcgcgtttgcagccattttaaaagatggcgtgccgatccggtttaccggccaggatacacagcgcggcacgttcgctcagcgcaatctcgtcctgcacgacgaacagacgggggaagaatacattccgcaccatcatctgtccggcgttcaaacttcatttgccatttataacagtccgctgactgaagctggcgtcgttggctttgaatacggctataacgtcttttcgccagatacgctcgtcatttgggaagcccagttcggcgattttgcaaacatggcgcaagtgatgtttgaccagttcatttcatctggcagggcaaaatgggggcaaaaatcagggcttgtcatgatgctgccgcacggatacgaaggacagggtccggaacattcaagcggcagggtggaacgcttcctgcaactggcagcggaaaacaactggacagtggcaaatgtttcgacagccggccaatacttccatattttaagaaggcaggcaaaatggctggcaaaagaagaaatccgcccgctcattctcatgacgccaaaaagcctgcttcgccacccgctggcatctgtagagccgtctgtactgacggacggaaaattccacaccgtgctggaaggcccgggtacgaaaaatacggatgcagtcgaaagaatcctgctttgcagcgggaaagtggctgtagacttggaagaaaagctgaacagtgcggaaaataccagctggctgcatacggtaagggttgagcaaatttatcctttccctgaacaggaattaaaggaaatgttcgcgcgctttaaaaacgcgaaagaaattgtatggatgcaagaggagccgaaaaatatgggttcctggtctttcgttgaagcgtatttaagaaagctggcgcctcagggagcggaaatccggtacatcggccggccgagaagatcaagcccgtcggaaggcgacccggtcgtccataaaaaggaacaaaacagaattctgactgaagccattacccgcccttaaacggcggcccgctccttccaaaggggcgggggcttcaatatgcgcaaaataaccgctgctttgcccgcttcatcctgcagcccgcacatgccgcgctgctcggaagatgaaggaggaggctttgatataaaaaaagtgatacttttaagggaggacaagtgttgtggctgaaattaaagtgcctgaactggcagaatccatcacggaaggaaccattgcacaatggttgaaacatccgggggaccatgtggacaaaggtgaatatattgtagaacttgagacagataaagtaaatgtagaagtcatttcggaagaagagggtgtcgtccagtccctcctttttgaagaaggggacacagtacaagttggcgatgtcattgcaattgtcggcgaaggaacaggggaaaacagtgcaacgccatccgcgccgcaaaaagaagcggaagcaccacaaccggcacaagcagaggcgccggcacaaacacaagcttttgctgcggaacagcaaaagccggcgcaaacacaagcgtctgctccggaacaacaaaagccggctcaggaagaaagcgaaagccgcccgattgcttctccggctgcccgcaaactggcacgcgaaaaaggcattgacttatcgcaagtgccggcagtggatccgcttggcagggtaaggaaacaagatgtggaaactttcaatccgcaagctgcggcaaaagcgccggcagcaccggaaaaacctgcagctggaaaagttgtgccggaagaagccggcaaaccgattgaaagaatccgcatgtcacgccgccgccagacgatcgcaaaacggctcgttgaagtgacacagacaacggcgatgctgacgacattcaacgaaattgatatgacagctgtcatggatttaagaaagcggaaaaaagaacagttcgttaaagatcatgacatccgtctcggttttatgtcgttctttacaaaagccgtggttgcgggattgaagaaatatccgtatgttaatgcggagattcagggcaatgagctgctgctgaaaaaatattatgatatcggcattgcagtatccacagaagaagggcttgtcgtaccggttgtccgggattgcgaccggaaatcgttcgcggaaattgaagcggatattgctgcatttgcccaaaaagcacgcgataataaacttgcattaagcgatctgcaggggggaacctttacgattacaaacggcggtgtcttcggctcgttgttctcgacaccgattatcaacgggacacaggttggtatcctcggcatgcacaccatacaaaaacgcccggttgcagtcgatggagaccgaattgagatccgcccgatgatgtacgtggcgctttcctatgaccaccgcgtcattgacggaaaggatgctgtcggtttcttgaaaacggtgaagacattaattgaaaaccctgaagatttgctgctggaatcttaatagtatgaaagaaaagcatcggttttgccgatgcttttctttttggtgccctttaagggttggcaatccagacgcttttgacttccgtatagttttggagtgcgtaagaacccatttcacgtccaatgccggattgtttataaccgccaaacggggaagcggcatcaaacacattgtagcagttgacccaaactgtgcccgcacggagacggtttgcaatatagtgcgcattggccacattttccgtccaaacccctgccgcaagcccgtactcgctgctgttggcgcggctgattacttcatcaagggattcatatggcatggccgcaataacaggaccgaaaatttcctctttggcgatcgtcatctcatcacggacatctgcaaaaatcgtcggttcaacaaagaagccttcttcacgcggttttttcccgcctgttacaatttccgctccttcatcgagtcctttttcaatgtaattcaaaacgcgcgcttgctgctcatctgaaacaagcggccccatttccgtatctttattgagcccgaagccctgcttaatcgactgggcgtgggaggccatatcggcaatgacattatcaaaatgtttcttttgaatgaacacgcgcgaaccggcacagcatacttgcccctggttgaacatgacaccgtttaaggcgccaggaatcgctttcgacaagtcggcatctggcaaaataatattcggggattttccgccaagttcgagcgtcacccgttttaacgttttcgaggcattggccataatcagttttccgacttcagtagaaccggtaaaggcaattttatctacaagcgggtggtcgacaagggcggctccggcagtttccccaaagcctggcacaatattgacaacgccgtccgggaagccagcctcgcttaccagctgcgccaagtaaagggcggaaagcggcgtttgttcagccggttttaagataatcgtgcagccggtcgcaagcgcggcacccattttccacattgccattaaaagagggaagttccaagggataatttgcccgacaaccccgaccggttcatggcgggtatagttaaagtaagggccgtttacgggaatggtctggccggtgattttcgttgtccagccggcataataccgcatatgttcgatggcaagcggaatatcggcatttgccgtttcacggatcggtttcccgttgtcgagcgtttcgagctgcgccagcgcttcccggtgctcttccatcagatccgccaatttatacattaaccggcttctatcggcagggttcatccgcggccacgggccttcgtcaaatgcttttctggctgcttgtacggcacggtcgatatcttgtttatccccttcatagatcgtagccagcgtttcgccggtagccggattcggcgtatcaaatgtttttccggatgcactttcaacaaattgcccgttgatgaacattttctttttgccctgaaggaaatgctgaaccctttcatccaactgcacggttaattgttccattccaacccctccatttatgttaatttcaaggagacaagcctccttatatacttgctttgtgcgccagcctgtcagcgcttacatccatattctactaaatatcaaaaatagacgcaatagaaatcattcgaataatttgaacataatctgcggaaaatcgcaaaaattcgacatacccctttatgaataattattcgctactaattttctaataaaaaataattattttatctttttattttactagtttcatattataatctatatatacatatattttaagaaacgagggataaaattgacaatgaatgagagaatggcactaaaaatccgcctggagcagctggaagacgctgagattcgggttatacaggaattccaaaaagaacgggaaaatatttttaaaagattaagggagctggatgaaaatgaaggccagcaggtaaaagcatccggcaaaccggaatatgtatcttttaatgcacttgcgtccgtctcgccggaaacctcaggcggcgaagcccttacgaatgaaagaaaggtgcggaaatcgcggtcgtcaaaaaagggcaggtcgggcaagatgagagaagaggctatccaaatactaaaaaacgtttcggaaccgatcagaggggctgaactgcagcggatgatcgaagaaaaaaccggctataaaatcgctaatatgacctctttcatgaaatccgtcgaaaaactcgatccgcgtatccgcaaaccggaccgtgggttgtacgaatttgtgaatgatacagcaaatacggaagaaccgcatcaggaaatggagcaaaatgagaacttgccggaggaaaacgaggcagttactgaacagaagtaaacctgtataaaaaatccccggaaacccggggctgtaaacaacataaaagcggcgggaacacatcaactgtgacccgccgcttttttatattttgatgatcagatacaattatgaattggattcttccttcggcggatgggactgataaaattttttctgaatcagtgtttgtccgatcataaagagcccgctcactgtccagtacagcggcagaaccgccggagctgaaaaagaaacaaaaaggatcatgatcggcgacatgagcatcatatatttcatttgtttcttctgttcctcaggaataccgatcagtgaaatttgggcttggataaaataaatgacaccagcgagaatggccatcggaatatctgtttgtccgagattaaaccataaaaaggagtgggtggcgatttctttcgagccgcggatcgcataataaaaccccattaaaatcggcatttggatgataatcggcaggcagcccatattcagcgggttaacgccgtgtttttgatacaaccccatcatttcctgctgcagctttgcctgttcttctttcgttttggccgctttgatttttgtctgcagcttatccatttccggcttcaaaactttcattttatcctgcatgatttgctgttttttgaatgtatgcagcataaaaggcatgagaatcagccggatgattaacgtcaaaacaataatggcaatcccgtaatcaccatgaagcagctgggccgttgctttaatgacaactgaaaacggggaaacaaaataatgatggaaaaatccaacgctgtgcgtgctgtttgttgaatttgaacatgcgcttaaaacgaacagcaaactgcttaaaaccaatgtaaaactgaaaaatcttttcatgaaatatcctcctttagtatattgcacaaatcctgtcctttctgaccggtcttaaatccggttccgaatcaggatcttcagaaggatatgtccgtattctgacgcaacttaaaatccaaatcgtaaagaaattgcaccggcattccgcagccgggcgggtgtgtacagtaaaatcctgcatgacggcggcaggccttgcttcaacaaacgctgccggcctgatcacaaaccggctcaaataaagaaaacctgctgccagtacgtaaaatgacagcgtgcagacggccgggtcatttacaaaatcgatgatgttttgaatcaaagctattcactcactttaaagagatcagtacaaagtatactttaattttgtctgttttacaatcgtaatcatcattttaccatacactgcgaaagaatcctaatttaagggagggggagcggctgcattgacggtgtgcagccgtttttcttttcagatgtttttttcaattcccttgccgtttttaaactgctatacttacattgaggtgtccaacatggataaagatcttttgcttgcctggtgggaagaagggatattgaccgtcccccagctcttattgaaaaaatacaaacagcttggcctgaatgaaacggaacttgtgcttttgctgcaagtttattcttttttaaaagagggaaatgcgtttccgacgcctgaagatctggcaggcaggcttaccattccggaaagtatgtgcgtttcgattttgcggcgtctaatccagcatcagtttttgtccattgaagaaggggaaggggaaggtggcatcctgtatgaaaaatattcgatcatgccgctgtgggcgaaactcgccgatgaatttatctatgagaaaaaacaggacgagcttgaaaaaagcgtaaacgaagaaaccgatttatacaccacgtttgaacaggagtttggcaggccgctgtcgccgctcgaatgcgaaacattggcgatgtggattgaccaggacgggcaatcccctgatctgatcaaagccgccctgcgcgaagccgtcatctccggcaaactgaatttccgctacatagaccgcattttgtttgaatggaaaaagaacggaatccggacggtggatgaagcacgtgaatatggaaggaatttccgtaaatcgtcaaaaccgcaaacagaaaaaccgaaaacgaccaatccggtgccgttttataactggctcgaacaataaaggtgacaataataattttatgtaaactagttacaggagtttgagaaatgctgacaaaaaaacaaatccggcattgccttgagacaatgggggaaatgtttccggatgcccgctgtgaattgaatcattcaaatccttttgagctgctgatcgcggtaacattatccgcccagtgcaccgatgcgctcgtcaataaagtgacaaaaaatctgtttcaaaagtataaaacgccggatgattatattgccgtgccgcttgaagaactgcagcaggacatccggtcgatcggcctataccgcaacaaagcaaaaaacatccaaaaactttgtcggatgctcatcgaggaatacgggcgggaagtgccgcaaacacgtgaagaactaatgaaactgcccggcgtcggcagaaaaacggcaaacgttgtcctgtcggttgcttttggcattccggccattgctgtcgatacccatgtggagagagtaagcaaacggctcggtttttgccgctacaaagacagtgtattggaagtggaacaaaccttaatgaaaaaagtgccgaaagaagaatggtcgatcacgcaccaccggatgatcttcttcggccgctaccattgtaaggcccagcgcccgcaatgtgaaatctgcccgcttcttgacctgtgcagggaagggaagaaacggatgaagcagaaagagaacaagaaataacaatacaaaaagcatggagaactgattctccatgcttttttggtgcgaaccggcgggagcacaggaagccatcaatcacgtgcttttttattcagaaccggtattgttatttgcggacgtgttgcccgaactgttttcgtctttattggaactgttcccgccgttcgtattggtcccttggtttccgtttgaaccgctgtttcccttgccatgagtgcctgctccattgtttgccggtctgtcatttccgcttgaagggccagtgcctgaactgtttcctggaccgttgttgttatctttgttgctgttgccgtttccgctgttttccgagccggtgccgtttgaattgccgctgtttgttcccttgtctgagccggtgttgtctttgttttcgccggactgattggtgtcagtgccggtattgctattcgtatttgaattgtttgcatccggttgtttttgggcattgtcttccggttgcttgttttggttatcatccgccttcgtgtccgtgctatcccccggaaccgttacactggcggatgccgctttgcttttcacgccatttaccgtggcggtgacattgaagacatacgttgcgcccgctttcggattggcaacggtgatcgattttcctgaagtcgaaccgaatgacgccgcgctgccgtttattgtgccggagacgttaaaggttgcacctgatccttcataatcccaggtaaccgtaatttttttgctgtttgcatcatacgctgcgtgaacatttgccggcgcatcctgggtaacggattttttatcaatcgctgtatcgatatggccgcggatatacaattcgcttcccattctgacgacacttttcggcatcgtaaagtcaggcgtttctttgccttccgatacatagcgcatcaagtggcggtaaatttgctgcgcgaccgtttgatacggccttgtgacgccatattttttgcctttctcgctttcgtatccggtccatacagctaacgaatatcttgtcgtgtagcccgcaaaccaggaatcccgcacagaagaactcaaaatcccgtattttgccagctcatctttatcaaaattcgttgtgcccgttttaccggcggcaggcaatcctggaatatgggcggttgtcccggtgccttttgtcagcacatctttcagcacgtccgtaatcatataagccgtaaaatcactcatggcgattttggactggacatgcggtttgatttccgtgaccccgtcacgcaggacaattttccggatggcatgcggcttgttgtatatgccttcattgccgaatgcggcgtaagcggaagccatctgcagcggtgaaacttgcacccctccgccgatggatgaagattcaacgatttctttgctgtttaaatcaaggccgagtttttttgcaaaacggatggccctttccttgccgacttctttatacgtttcataggcaggaatattccgtgataaatacagtgccttgcgcatgctcatcttgccaaggaaccggttatcccagtcattaatcggcgttccgtccgaataagtggttgccacatcgttcaattggtgcccggttgaccagtgcaagtactcaatcgccggcccgtagtcaagaatcggtttgatcgttgatcccggcgaacgcttcgtatcaacggcatagttgaagccacggtcaagtttcatattgcgcccgccgccgagcgcacggatttcgcctgttttcgtatcgatcagggcaatgccggcctgcatttttttatccggataattgatgatcgaattggtgtttaagattttttccgtatattgctgtgcggaagaatccagggttgtataaatggttaaaccatcggcatacacattatagttcccgagtttctgcacttccttaatgacttcattgacaaaggcaggatatttgttcgcgtttgtattccgctctttttctttgaccagtccggccgaaaccggggtggcctgcgctttttccatttctgcctttgtaattttattgtttttgtacatcatcgaaaggacaatgtcccttcttttcttcgtcagatccggatggtcaaacggattataattattcgggctttgtggcatgccggccagtacggcaatttccggcagtgataatttgcttaaagatttgccataataatgttcagcggctgtctcaaagccgaagacaccgtctgacatatagactttattgacatacatttcaaggatttcatgctttgtatatttccgctcaagctggatcgccagccacgcttcctgggccttccgctttaatgttttttcgtttttattatttaacgccatggaaacgacctgctgggtgagggtgctcgccccctcggatccgaaccctttggtaaagtttgcgaccaccgcacccccaagccgaatcgggtcgatcccgtggtgctgatagaaccgtgcatcttctgtcgaaagaatcgcgttttccatctgttttggaagctcttcataatcaatatatttccggttctgtgccccgagcgttgcgactgttttgttgcttttatccttaatcaccgatggaatcgggtcggataactgcttcttcgtcagtttcggggagctgcttgcgtaatacgcaaaagtgctgattcccgcaatgactccggccagcccgacaagaaagcagacaagaatgagccgctttataaatgttaaaaatttgtttttcggttttttccttttctttttatgttgatttgcctgcatttgtttccggcgttcttcgcgggattggtatttttctgccatgctcagcattcctttcttctaaatctgaaaaagccgatttagattcaaaacatattgttgccggatccgtcaatcatccggccgggcaacaactataaagcatacaattgttttaaaacggcgatgtaatcaattctcggccggtatccaaccggtatagggtgcccgttttcttcaatttcttctttttttatcgattttctccctccggcaagcattctatcccaataaaaaaataaatggcgggattccagcaaaaaaatttcttcttctttcgcaaaacggagaatgacaaagcaaattccgccttgcgccaccacctgtttcatatggctgatttgatgctcatggaagttatgaagcggaaaagaagtatggttttgcgtttcctttgcttcaaagtctatatatttaccgttcatcaccccgttgtaatcggttgtggacggctgtttaaaataggcttctttaatgacggctgtgctccgtgactgataatcgacctggacaatctggatcggggtcggttttttatggataacggcaatgccttcctgcaaataataagcattggtttcattcagatcctcttccagtgtcatcccacggttgccgtataaaatttggttcgcatttttccgtccggctttgttttttttccctttatacttttttccgtttggataacgcaattccatgttccctcacctcataagctaaattatatcatagcagaacagacaaagaatatgtaataaaaaaaacagtctttcggccccttttgcgccggcgggggacaaggaaccggcctgcccggtttttttcgctaaaaacaggcaaaacaaaaagcaaggaaacatttccttgctttttgctttcattaggtggaagggcggtcagggccgttcagcttcttatctccttttgccaaagaccctttctgttcccgtgcttttttctgttgttgtgctttgttgtcattcgttttcatggaaacccacctcctgaaattggtgtcaccggattttccggcatatttattgtttgcagttccgccttttgcatacatgccggcacgaaagttggcgcagccgggaaaaatgcgcccaaaatggaggcacgctgtcgaaagaaaacgcaaaatgaagaaacccgttttctttgccgaattgcttctagttttgtcaggcatgaagggaccgggccgcctggcagagaatgaataggcatgatgaaattcaagggggaaaacaaatgataccgaaagccgcatttttaaacgggctggaaaaaatggaagaggcactcgaaaatattgggacagagatccggcataaggcggagaaggaagcaagaaagcagtcgataaagcagtggtaccatttgaaaaaagcagaaatgaagctggatcatttggaaaaaagggcggaagcattcagaaaaacatacagggcggaaagcttgcggattgatgaaaacaaaaaaacttcctaaaatgaaagaagtctcccgtaaaaaaacccggcgaagggagaatatccggttagaagggtgaacagaaatggaagaagggcaattacaagcgttaaacgagcagctgattgcgtacacgcttgagctttacgacctgtaccaggaagtaaaggaaacaggggtggaaaaggattttttcagcgaagtcaagcctttttgcgatacgttgcaggatgccattgacaggtggctcccggccgcaaaagcatgggtggaagcccggaggccggcgcatctttttccgtcccagcttgaacatacggccgaaaatttgcaaatggttgcggtgcgtgctttttacccgtcatcgagccgcaaaatgatgctcgaccattttcagtcggtgaaatatattctccaatgcttgcaggaagcattggagaaatcgtaaaggatatggacacatcaccaattgccagatgccacatacattattggtgaagcaggcaggaggcgatggcaatgcgcgtttttcaagatccttacagcagccggcgcacaagaaacataggacggtatcctgtaatgccgggggccggtccgtattacccgcaatttccatatcccgggcagcattccccgcatgtttatggataccccccagcgccgtatccgtacggccagcatccgggcgggtacggtcaggcctggcatatgcacggacaaagcggccagcatgccggggaagaagctgccatgcatttgttcggaaacccgctcgaggcagctgaaaagccaaacacccagcacggtgcggcagggttcggccatccgtacccgcatcagcctgttccgccaaagccgccgcaaatggggggatcttttttgaattccttcaaatcccaggatggctccattgattttaataaaatggtcaatactgccggacagatgatcaatgcgattaatcaagtatcatcgatggtcaaagggctcgggggcctgtttacaaaataggcttccgggccgttttgcttaaaaaagggacaaaaaacggaaaaaaccgggacgctcccggcctcttattcaatcctcagcttttttttctttcctttcggcatcaaaatcacaagcagcccgttttcaaattttgcctgaatctgatccccgtccaccagtggcggcaggggcaccgtccggcttatccggcggaatgcgcttttcttttcgtaagcttttttcgtttcatccaaacttgaaacggcttcctcatgcctggcgctaatggtgagatattgatcataaacttcaatctcaatctggcctttttcatacccgggcagtttggctgtcagtacataagcttcatctttttcttcaaggcggaccgggatcgtatcaaaagaaaaaaattcatcgagattctcaaaaaaatgtttgaccggtttttcctgaaaaaattggtccatcgcttgcatcagcccgtaaaaaggatgcttttcatccgggccggataaattggacatcggcaggctcctttcttattgatgataaagaaaatgaatggttgcacagcactctttcgctgtataatatgaaaaccaagcggaaaatgtgaaagaatgcttttaaaacgaacgtctattcgatataatagatagcggggtgaggaaagatgttcagaaaaaagaatttgcaggaaatattggagcagttgcagatggaccgttctttccaggaacggattgtccattggcatacgattgaaggaaagccggctgtaacggtgccttttcctggcagcatcacaccggctgtgctttcggcactcgaaaaaagaggaatttcgtcattgtatacccaccaggcagaggcatatcagcttgccatggcaggaaaagattttacggccgttaccccgactgcatcaggcaaaacgctttgttataatctgcctgtgctcgagaccatccttcaaaacccagatgcacgcgcgctctatatgtttccgacaaaagcgctcgcgcaggaccagaaaagtgaaataaacgaaatcattgaagaagccggcgtgccggtaaacagttatacatatgacggggacacgccttcaaatatccggcagcgcgttcgcaaagccggccatatcgtcattaccaatccggatatgctgcattccgccattttgccccaccatacaaaatgggtgtcgttttttgaaaatctaagatttgtggtgatcgacgaactgcatatataccgcggtgtgttcggcagccatgtcgccaatgtgttgcgcagattaaagcggatttgccgttattacgggagcgatccggtttttatttgcacgtccgcgacgatccaaaacccgaaagagctggcggaaaagctaaccggcaaaaaaatggaactgattgaccaaaacggcgcgccaagtggaacgaagcattttcttttttacaacccgccgcttgtgaataagccgttgaacatccggagaagcgccacgcttgaagtccggaaaattgcaggggaacttttgaaaaacaaaatccagacgattgtttttgcaagaagtcgtgtgcgcgtcgaaatcatcttaaaatacttgcaggaactcgtaaaagatgaactcggggaaaagtcgatcatgggctacaggggaggatatcttccaacggagcggcggaaaatcgagcagggattaagaaatggggacatatacgggattgtcagcacgaacgccctcgagctcggtgtcgatatcggccagctccaggtctgtattatgaccggctatccgggcacaattgcgagcgcctggcagcaggccgggcgcgcaggaagaaggcagggggaatcgctcgtcatccttgttgccggctcaagcccgcttgaccagtacatcatccgtaatccgggcttctttttcaaccggtccccggagacagcgcgcatcaaccccgataatcttgtcattttagtggaccatgtcaaatgcgctgcatacgaactaccgtttaaaaaaggggaaacgtttggcaacgttgaaatcgaggacgtgctcgagtttttagcggatgaacggattctccaccggcgcggggatgcctggtactggatgaatgatgcttttccggcccacaatatcagccttcgttccgcgtcgcaggaaaatgtcgtcattatcgatatgacccatgcgccggatgtgcgcgtgatcggtgaaatggaccagttcagcgcgatgacattgctccatgaagaggcgatttatttgcatcaggcggtgcagtatcaggttgaaaagctggactgggaagagaaaaaggcatttgtccgtgaagtcgctgttgattattacacggatgccaatctggcggtggagctgaaagtgctggaacaagaccgaaagaccgttttgcaggatgccatcatcggctatggggatgtgatggtccgggcgatgccgacgattttcaaaaaaattaaatttaacacgcatgaaaacattggctcggggccgatccaccttccggaaatggaactgcacacgaatgccgtttggttttccatgggggaagatgcggtgccaaaacatttgctggaaggcgcgcttaccggcgctgcgcacgcactccagtcgattgcgccgctttttgccatgtgtgatgcccatgatatccaggccgtgccccaggtgaaagcgatccatgacgaaaagccaacaatctttttgtatgaccggtatccgggcggcatcggcctgagtgaaaaaatctatggcggggctagggaaattttggaatctgcaagagcgatggttgtaaactgcccttgcgaagacgggtgcccttcctgtacgggcgcagaaacggctgccgcgggcgcaaaacaggccgccgtccggctgtttgatttctggctcggggcgatcaaaggaggggcgcaacatgccgggattaaaagataaattaaaccggatgaaaaaccatatcgtgagagaccagcctgagcctgccgaacgggtggaagcatcccagaccgattctgttcctttctttgaaatgtgggaaaaggcgggcgcttcgctgtatgatttggatggcgagtactgcctcatccgtgaagtccgctacccgcttgaaacaaagcacggcaaatatgcttttcgcgactattttgatgccgtcaaactgtggcagcaaaagccggtccggcaccctttatccgccaaaggctacagcccgtttgatttgttttttttcgataccgaaacgaccggcctcgggggaggggcgggcaacacgatttttttgctcggatatgcttcctttaccgaagaaaatgtcattttaaaacagcatattcttccggaaccggggcttgaagtgccgctttactacagtttcctggaaaatatcgattacactgcgctcgttacatataacgggaaggcgtttgactggccccaggtaaagacgcgccatacgcttatccgcgaccacgtgccgcgtctgcctgaatttggccattttgacttgtaccacgcggcaaaaaggctgtggaaagatgaacttgggtccgtgaaattagcgaatgtggagcgtgaaattctgggagtggaacgcgaggaggatattccgggatatttggcgccgatgatttattttgatttcgttgagcgcaaaaatccggaaggcctgcttggcgtcatccgccataacgaagaggacattttatcgcttatttctttgtatacccaccttacgtttcaaattcttgagaccgacccaaaccagacggcaaaggaaaaacggcttatcgggaaatggtttgaatatatcggcgaagatgatgccgccgtgaaaagttttgaagcggccgccggcgaaaatgatctggctgccaaacaccgtctggccttccagtataaaaaacaaaaagcatacaggaaagccggaatgctttgggctgaattagccgaaaatgcgccggatacgatcagagccgaagcgtgcattgagctttccaaactgtatgaacacaagaaaaaagaccttttgcaagccgtccgctatgccgaaaagggactggaaatttatcaaaagtacggcaagttcggttcagggaaatggaaaaaatgctgtttggaaacggaaaaacgccttttacggttgtaccggaaagcccaaatcccggcgagatcctctttcagcaaggaaatgtccgggaaaagaaccggtttttaaccgctatttcctgggcaagcgcatgattcgacggggaattcgggattttgaaacgccccttgttgggatttgtcggtttcttttggatcagagaaaaatgcgcgtcctttgtcgatttccgccatttttattgcagtccgccaaaagtcccgttaaaatggtttttgatcaaaatgaattgttaaagaggtcgaaaaacgatgcaccgggcgacgtgggagagggagttgtggattaaaacggcaaattgggttttttccttagtacatgttccctttccgagtcataggttagtagtgtaagaaaaaagacgtctgatgatgaaaggagatcggaacatgtttcaccaccattgcccgccgcggatcatgccggctgttgtgcatccgacaaaatgctgcgttacgcacaccgtccaggatgtcatcgtgccgcatgttttcccgacgcatacaacccatgtgaatcaccatgtatttcatcagcaaaactactttccgcacacggaatcgtacgtcaatcaaaccgatccgggaacggtcagcaacttttttgatccagtcaaaccgcacgggccgaagtgctgctgacaaatggacggcaagggcaaaccttgccgtcctgcttttaggaatacaaaaaacgaggagcgaaatgcattgggaaaagttgtcgccattacaggttataaaccgtatgaactggggatattcgggacggaccacccgggtattcgctatatccaaacggccatcagaaggcggttagtggaattgctcgatgaagggtacgaatgggtcctcatttccgggcagcagggcaccgaactttgggccgctgaaaccgtttttgatctacaagcggaatacccggaacttaaactcgctgtgttaatgccatttgaagggcaggaagaaaagtggaaagacgaacaaaaagcatactacgagatggtgctttcccaggccgattttgttgccgccatctcgaaaaggccgtacgaaagcccgcagcagttccgcaataaaaaccggattttcttacataaaagcgactgcctgatgattgtgtatgacgaagaacgcgaagggtctccgaaatacttgttcgaagctgcaaaaaagttcagcgaatcgcatccgtatgacatccgcatcattgacttttacgatttacaggcaataatagaagaagaacagacagatttttaggcaagctgtggtacaattgacaaataaaaaggtttttgaaaaaatgaaattatgtctgggagatgtaaggtggtgcaaacatgttatcggatcaaattaaattgacggcgaaagacattttggaaaaagagtttaaaacggctgtcagaggctaccggcaggaagaagtagacaaatttttggatctgatcataaaagattatgaaacgtttaatcagacgattgaggagctccagcaggaaaacctccggctcaaaaagcaggcggaagaactggcaaaacggcagcctgtacagcaaatgaccgggacaacgaatttcgatattttaaaacggctgtccaatcttgaaaaacatgttttcggcaacaaattaaatgaatagccggctaaaaaatgtgtgaaatttttctgtggaaaagggcacggggaagcggcataaaaaaacagacaatcgcttgcccgaacccggtatggcaatgcagggggaagaaattgacacatccgttaaaaattacagcttgcaagtcccggtttctttttatataatagataagcgttgtgaataacgttcgggtaatcgctgcagcctgaaaacggctgttgaggaaagtccatgctcgcacggtgctgagatgcccgtagtgtttgtgcctggcgaattcataagccagggcagccttgattcaaggctgacggcagggaaaacgcctaaacctttaacggcatggcggagtacccttgaaagtgccacagtgacgaagctttacgggaaaccgtaaaggtggaacgaggtaaaccccgcaagtgagcaactcaaatcatggtagaggcactctttctgaggaaatgaacgaggaaagagacaagcgtattgcttgtagatagatgattaccgccttcgtacgagatgacgccacatcgtttgcagtacaaaggcacagaacatggcttacagaacgttattctggctgaatcggaagaatcgggccggcgctgcggtattttgatatacagcaggcgcccggccttttttatacataattttttaaaacgtgttatttggtacggcatgccatacaataagaaatattagacgagagatggtgggaaaatgtctgactttcaattgatcgcgacaagcgcaatggggatcgaggcgcttgtagcaaaagaagtgcgcgcactcggctacgactgtacggtggaaaacgggaaaatcgaatttgccggggatgaatcggcgattgcccgtgccaatctttggctgaggtgcgcggaccgcgtcaaaatcaaagccgctgaatttaaggcggaaactttcgatgaactgtttgaagggacaaaagcggttccctgggaggattttctgccgcgcgatgccgagttccccgtcaccggaaaatcggtcaagtcaaagctattcagtgtcccggactgccaggggatcgtcaaaaaagcaatcgttgaacggctaaagtcccgctataaaggaacgagctggtttgaagaaaacggcccgctttttaaaatagaagtggcgttattaaaagacgtggccacgattacgatcgatacaagcggggccgggctgcataaacgcggctatcgcgcggcacaagggccggcaccgatcaaagaaacgcttgccgctgcactgatccggctgacaaactggcacccggaccggccgtttcgcgatccgttttccggctccggcacgattccgatcgaagctgcgctcatcgggcaaaatattgcaccgggttttaaccgcgattttttatgtgaaacatggccgtggatgagtgagaccgtctttgaaaaagcgcgcgaagaagcggaagatctcgcccagtacgaccagccgcttgatatagccggttcagatatcgaccccgggatggttgaaatcgcacagcaaaacgccaatgaggcagggcttggcggcatcgtcacgtttaaacagatgcaagtggccgattttacggcgcaggaagcatacggcacgattgtgggcaatccgccgtacggtgagagaattggtgaacgggcggaagtggaaaacatgtaccgggagatgggccgggcatttgccaagcttgacacgtggtcagtttatattttgacgtcggacgaacagtttgaacgcgcatacggcaaaaaagcgacgaaaaagagaaagctttataacgggtcgatcaaaaccgatctgtaccagttttggggaccgcgcctgccgcggaaaacagaaaactaagcaagccgaatggttatcgtttgtgcgccgcgtgaaacatgataagatggacgtgcaagtgatttgacgggaggcatgatgatgggaacagagtcgattgaaaaactggagcaggactttttggcatatgtcaaaaaaatcaaagcttatgaagaagcgctcgccctcatatactgggatttgcggaccggcgcgccgaaaaaaggcgtcgggcagcgcgcggaagtgatcggcattttatcgggtgaagtctttgacatgcaaacttcaaaagaaatggccgaatttttggagaagcttttgccgcacaagcagcaattgccggaacggacagccggtacattggaagaatgccggaaaacatacgaacgcagcaaaaaaatcccgcctgacgaataccaggcttatacggtgctcgtctcgaaagcggaaaatgtttgggaagaagcaaaggaaaaagcagacttctccttgttcaagccttatctcgaacaaatcgtggcattcaaaaagaaatttgtccgctactgggggtatgaaggccatccgtataatcccctgctcgatctgtatgaaccgggcatgacggtcgatgtgctcgaccgtgtgttcaaacaagtgaaggatgcgattgtgccgcttgtccagaaaatcagtatgtcggaagaaaaaccggatacggcatttctttttcacccgttcccgaaagaaaagcaaaaagcgtttacgcttgaaattctaaagcaaatgggctttgactttgaggcgggacggctggatgaaacggtgcatccgtttgcaaccggcatcaaccagggggatgtgcggattacgacacgttataatgaaaacgactggcgcgtcgatgtgttcggtgtcatgcatgaaggcgggcacgctttgtatgagcagcatatttcaaaagatctgtcgggtacgccgcttgcagaaggcgcgtcaatggggatacacgaatcacaatccctgttttttgaaaacatcatcggccgttcttttccgttctggaagaaaaattatccgcttttgaaacagtttgcatccgggcagtttgatgacgtgccgcttgaagcattttaccgtgcagtgaacgaggcgaaaccatccctgatccggattgaagccgatatgctgacgtatccgcttcatattatggtgcggtatgaaattgaaaaagcgctcctcaatgatgaaatcgaaatcggggacctcccggaaatctggaatgcgaaatatgaggactatcttggcatccggccggcacatgacggggaaggcgtcctccaggatgtgcattgggccggcggggatttcggctattttccgtcttatgcgctcggcctgatgtacgccgcccagttcaaacatgcgatgttaaaatcgcttccagattttgacaagcttgtggaatcgggcaatctggagccggtccgagaatggctcacggcgcatgttcaccggttcggcaaattgaaaaaacctgccgatattttgcgcgatgccactggtgaagcgctcaacccgaaatacttgattgattacttaaccgaaaaatataccgatgtataccggatcaaagattaagatagaactttcggctaacaaacagtgcggcagccgccggtttcagaaagaaaaccggaaacctgcgtatgctgcagatccggtgtgcgtagcctaacacaggcaattgtaacgatggaaaaaacggtggatattccggtttttctatccatgttgcccgccgacttttctgtaaaattttcggcggatgttgcctgcattttgccaaacgcgaacaaaaagaaagacggaaaatccgccgttcggaaatttcgtctttacatgccggaaagatacccttatacttttattataaaaactgaacgcattcactcatataatcgcgggaatatggcccgcaagtttctaccaggctgccgtaaacggcctgactatgggtgggcaatgggaacgttgtggatgttccttttcctttttgcacatgaaaaagctcaaaggcgttgcttactccattttttgtgggtgcagcggcctttgggctttttttctgaaggccgcatgtttcaatcaagatcaatgcagcgaaggcaaagaggaggaaaaacattgaaagctttacaagaaaaaattagaaaagatggcatcgtgctttcggacgaggtgctgaaagtggacgcttttttaaatcatcaggtcgatcctgtccttatgaaacagatcggggaaacatttgccgggctgtttaagcaggatggtgtaaccaaaattttgacgctcgaatcttctggtatttcgcccgcattaatgacagcacttgaattaaacgttccgatggtttttgcccggaaaagaaaaccgttcacgcaggacgcggacgtatatgaagcttccgttcattcatttacaaaacaaacaaaccatatcatttccgtttcgcgcgcttttttaaatcaagctgaccgggtgcttatcgtcgatgattttctcgcaaacggccaggcagcagaagggctgatcgatataatagaccaggcgggggctgaactttgcggcatcggcattgtgattgaaaaagcattccagccgggcggaaaaaggctgcgcgaccggggcatccgcgtggagtcgctcgcatccatccggtcgcttgaaaacggtacggtcacatttcaagaggaggcgcatgccaaatgaaaccggaaaaaacgaaaatgaccgtactggcgatccagcacgttttggcgatgtatgcgggtgctgtcattgtgccgattattaccggcagttccctggggatgaacagcaggcagctgacgtatcttgtttccgttgatattttcatgtcaggccttgcgacactgctgcaaatctggaaaaaccggtttttcggcatcgggcttccgattgtgctcggctgcacctttaccgctgttgggccgatgatcgcaatcggcaagcagtacggcgtttcagctgtgtacggcgccattctcgtatcagggctgtttgtcattttgatcagcaaatttttcagcaagctggcccgctttttcccgccagttgtaactgggtcggttgtcacgattatcggcgtgacgcttattccggttgccatgaaagatatggcgggcggagacggaagcaaagatttcggctccctgaccaatattgctctttcattcggcactttgctcattattgtccttttgcagcggtttgcaaaagggtttatccgttcgatctcgattttaatcgggctggcaatcggcaccgtcgcggctgcattgttcggaaaggtcagctttgccccggttgcggaagcctcatgggtgcatatcgtgcagccgttttatttcggcatgccgacttttgagtggagcgcttgtatcacgatgatccttgtggcgctcgtcagtcttgtggagtcttccggtgtttacttcgctttaagcgggatcaccaaacagccgctccatgaagatgaccttgcgaggggttatcgggctgaaggtcttgccgtcatgcttggcggattatttaatgctttcccgtacaccgctttttctcaaaacgtcggcctcatccagctttcgggcgtgaaatcgaaaaacgtgatggtacttgtcggctcctttttgctcctttttgggctgattccgaaattaggcgccctaacgacgattattccatcttccgtactcggcggggcgatgattgcgatgttcgggatggtcattgcgtcaggcatcaaaatgctaagcaaagtcgatttcgccaataacgaaaacttgtttatcattgcctgttcaatcgggattggccttggcgtcacggtggtaccggatattttcaaaggtttgccatcgaatatccagctccttacgcaaagtgggattgtcgcaggcagtgtgacggcgattgtgctgaatctttttttccatatccttccgaataaacaagcggcaaaagcaaaggtgaaaaaagtcgggacacaggcatcctgacagcatgaaaaaagctgaaccggaatccggttcagcttttttcgggttaatttaaatcgccggtattgatgaccggctgtgcggcccggtcggatacaatcgaaaccatcagattgttgatcatcaccattttccgctcttcgtccagttcaaagccgtctttttccagttgcgcaatcgccatctgggcatgccgactgccccttccacgatttttttccgggcggcaagaatggcggaagcttgctggcgctgcagcatgacgctggcaatttctgtagagtaggcaaggtgcgtgaggcgcgcttccataatttccacgccggcaacgtcaaggcgcggctggagttcctcttttaaatgtttggagacttcctccccgtttccgcgcagtgaaattccttcttcctccgcgctgtcataagggtattttgtggcaacatggcggagcgccgtttcgctttgaatctcaacaaattcctcgtagtcctccacattaaacacggcttttgcagcatccactacacggaacacgatgactgccgcaatttcaatcggatttccgtccacgtcattcacttttaatttggcgctgttaaaattccttacccgcaacgaaacgcgccgccttacactgagcgggatcgttacgtaaaagccgctttcccggatcgcgcctacatagcggccgaaaaaagtgacaaccagcgcctgattcggttggatgacacaaattcccgagacaagcaggacgcttatggcaagcaggacaataccggcaaaaaaattgacggcaaaaaggaaaaacaaacctagaagcgcgaaaacgacaatcgctaaaatcccgagaaaaccgtttatgtgccaggctttcttttcggacatcttatccccacctcttttaatttctcttcacttcatcataacatgccggcatattgccgtcacgctgaggcggggaaaatcccgtactattttaacaaaacaaaaagccgccgaagtgtggcggctactgccggtttgactgccattcctgaaaggagcccgttccgttgcatccggaacagtcaaacggataagcgtattcgtatgcggccggcatgataaaaccgcgcccgccgcaatccggacatttgttttgttcctgcatcgtggatatgtatttttcacgtcttgcggactgccaggcagaaagggaacgaaataatcccatctgcggtcacctcctgatacagccatattataggtttttttccggaaaattatccgcggcccgcggcattcgcccaggcaagggaaaaaatgagtctaatatagtatgaatacgatgaaaaattcgttaaaatagagctatcaacacacaatggggagtaaagtgatggccaaactacaggaaaaaagcaaaaacacaacacggattttaagcttaattgaacatttccggcaaaacggggatgaacaaagggtggaaaaagcgaaaaacctgctgaaaaaagtccgccgcgaagactttcatatcgcgttttgcgggcatttttcagccggcaagtccaccatgattaacgcgcttttaggcagccgtgttcttccgtcaagcccgattccgacgagcgccaatcttgtcaaaattgaaaaggggacggaagactgtgccatcgtttatgaaaaaggggaagcccctttgatttttcacgcgccgtatgattttgaagttgtcaaaaattattgcaaaaaagggcatgtccaggaaattgaaatcactaagcccgattccgatttgccggcgggattgacggtgatggatacgccgggtgtcgattcaaccaacgatgcgcaccggattgccacggaatcggctatttatatggcggatcttgtcttttatgtgatggattacaaccatgtccagtcggaactcaattttacctttacaaaagaactgctcgatcacgggcttgaactttatttaattattaaccagattgacaagcaccagagcgaagagctgccgttttccgcattccggcggggggttgaaaatgcatttgcatcctggcatgtccagccgggcggcattttttacacctctttaaaagacccggatcatcccgataatgaatttggccggctgaaagcgctcattgaccacgccgtttccgaaaaatccgcccgactggaacggtctgttgaagcatccttaagcgtcttggaaaaagagcatgacgactggcttgaagcgcagtacgcaccgcaaaaagcagcatatgaggaagtgcttgcaaaatattcgggcaccgggaaaacggaagcgtacgaagcggaacaagagtggcttgaaaaagaacgggcgcttcttacccgcattgaaaattgggatgaggatacgcggcaaaagcttcaaacgcttctggacggcgcctatttaatgccgtttgaaacgagagagaaagcaaaggcgtatcttgaaagcatgcaaaaagatttccatgccggcggtttttttgcaaagaagaaaaaaaccgaagaagcaagaaaacagcggctccatgatttctatgccgccctcgaagccaataccgaagcacaaatcgactggcatctccgcccgctggcgcaagaagctttaaaaccgctgcatcttgctggcgcgcaaatgctggaacaacaggccggcatgcttaaagcagatttcagcgaagcaatgctcgccgcccaggtaaaagagggtgcacggctgacaggcgactatatcctccattattgcgaaaatgtctcggatgaaatcaaacgagccgcccgtgaggcttggaacgattggaaagcgctcgtcctgaaacaggctgccttggaaacggatgaacagcttaaaatggttcggaaaaaggccgtgcaggcaaaagaactggcagaggcttacaggaatctcgaaaaaatagaaaggcagcttgccgaaaaacggactgaattgaaagcgcctgccgcacatccggaacagctgctggctgaaatagagaaagaatgggcgggtgaaaaggcgcattaccgggtgtatcgcggggaaaaggatgcaaaacagcctgaagaaaccggcaaggctttagaaagcccgggcccgacagaaaaacaagccggcacattgccgcctgaaaccgtgcttgccaaaatagagcaggcgattacgctgcttaagcaccagcacggtttcgggcggtataccgaaacgctcagaaccaaaagcaggcgcctgaaaaaccgccgctataccgttgcgctgttcggcgcgttcagcgcgggaaaatcgtcttttgcaaacgcgcttgccggcgaaaaagtactgccggtttcaccgaatcccaccacagcggccatttgcaggatctgcccgcctgatgcggcacatccgcataaaacagcagccgtaaagctgaaaacggaggcgcagatgctggaagatgtaaacaagtcgctcgctgttttcgggcatagttgccgttcgttcggagaagcgcttgaaaaaattgaaactttacaagcaaaagaaacgggcaaagcaaacgaaaaagtccatttatcttttttgcgtgcctttgcgaaaggcttccctgattttaacgggcgggacggacagaacttgaatgtcggaatggaagcgttccgccggtttgttgccgatgaaacccagtcttgttttgttgaatccattgatttgttttatgattgcccgttcacaagacttggcattacgcttgtcgatacgcccggagccgactcgatcaatgcccggcataccggcgtagcatttgaatatattaaagactcggatgcggttttcttcgtcacatactacaaccatgccttcgcgcgcgcagacagggaatttctcatccagctcgggcgggtaaaagaagcatttgaactggataagatgttttttattgtcaatgcgattgatcttgcctcgtccggcgaagaatataaagaagtgatggactatgtcaggggtcaactgctccatttcggcatccgcaatccgcgcctttatggtgtatcaagcctgcttgcgctttcaggcaggcgggaggaagcgaaaatggccgaatttgaagcgggcttccgccaatttctcgaccatgatttgctgaatatggtgcttcagtctgcacaaaacgagctggaacgcggccttgccatggtggatgccgtgatccgcgatgccaatgaatcgattgaaacaaagaaagcgaaacgggaacttctccggaaacggcgggaagaggcagaagccattttgaaaaatacaaagccggcgtttttcacggacagcttcatgcaggagcagaaggagctgctctattacgtaaaacagcgcgttttctaccgcttcgccgactttttcaaggaagcttttaatccggcaacggtgaaggcagcgaaagatttgccgggcgcccttcaagagcttgcagaactcgttggctatgattttgcgcaggagatgcgggcgacaaatgtaaggcttgaagcccattgccggaaattattcacattgcaaagcgcggaatggaacagggagatgaaacgtttgcttcctgatttgtctgtcagcacgtttgaagcgggcgcacacgctacgcctgattttcctgcggccttttcggaaacggatttggaaccgtttgaaaaggcattccgccattttaaaaatgcgcgcactttttttgaaaaagggggaaaagccggcatgcaggaagaactgcaggcgatgtttgaaccgcttgcgcagcagtatcttgacgtgcaaggagaaaagcttgccggttcgttccgctcatggctggaggaagagtttgcgaaaatgcaatcggaagctttactcgatattgccgaacagttcgatgcccgtcttgaagcccttgaagaaagtgtgaacgtggcagaatggatggaaatccgcgaaaaactcgttttgccttcctgaggataaaaaatgatgtgagaaaatataacattttgttgacaaaaaaactcacatggaatatagtaaaaatataaagaaaaggagcgtataacatgggtcgaaaagaaatccgccgttcgatgccgcttttgccgatcggaaccgttatgaagctaacagatttatcggcccggcagatccgctattatgaagaacacgagctgattacaccggcaagaacggaaggcaatcgccgcctttattctttaaatgatgtcgaccggcttcttgatattaaagatttgctggatcaggggatcaatattgcaggcatcaaaaaaatcttattgatgaacgaccgccgcggaaccgggccggtactcgtcaaaaatcatgtaacggatgaagaaatccgcaaacggcttcgccaggaactgctgcaggccggccgttttcaaagaccgagccagcggttgtccgatgcgccccggtttttccattaacattgttgaaaagctagttttatagcttagatatatactttttattgcctaaagggaggaatactgttcatgcctaagtttacacgtgaagatattttgaagaatgccgaagaacaaaatgtgaaattcatccgcttgcagttcacggatattttggggacgattaaaaacgtggaaatcccgctcagccagcttgaaaaagcgctcgacaataaaatcatgttcgacggctcttcgattgaagggtttgtccggattgaagaatcggatatgtatctgtatccggactatgatacatgggtcattttcccgtggaccgctgagaaagggaaagtcgcccgtctgatttgcgatatttataatccggacggcaccccgtttgaaggtgatccgcggaataatttgaaacgggtattgaaagaaatggaagaacttggcttcacgagttttaatcttgggcctgaaccggaattcttcctcttcaagctgaatgaaaaaaatgaaccgacactggagctgaacgacaacggcggctattttgacctggcgccgacggaccttggcgaaaactgccggcgcgacatcgtattggaactcgaggaaatgggctttgaaattgaagcgtcccaccatgaagttgcacccggccagcacgaaattgattttaaatatgcggatgcagtcagggcatgcgacaatatccagacctttaaactggtggtcaagacgattgcacgcaaacatggcctgcatgcgacgtttatgccgaaaccgttgtttggcgtgaacggttccgggatgcacaccaatctttcgctttttaaaggaaaagaaaatgcattctatgacccgaacgatgcagaactgcagctgagcgatacggcataccagttcattgccggcattatgaagcatgcttcgaactttacggctgtcacgaatccgacggtgaactcctataaacggcttgtgccgggttatgaagcgccttgttatgttgcctggtccgctcgcaaccgcagcccgctcatgcggattccggcttcccgcggtttaagcacgcgcgttgaggtgcgcagcgttgacccgtctgccaatccgtatctcgcgctcgccgtcctgttaaaagcagggcttgacggcatcgcgaacaaattgcaggcgccggaaccggtcgaccgcaacatctatgtcatgacgaaagaagaaagagaagaagccggcattgtcgacctcccgggcacactgctgcaggcgctggaaaacttaaaatcggatgatgtaatggtagacgcccttggcgatcacattctcgaacacttccttgaagctaaggaaattgaatgggatatgttccgcacacaagtccaccaatgggaacgcgaccagtatatcgaaatgtattaagcaagaaaccccttgaagcgtaaggctttgaggggtttttgtattttggtcaaattgcttttttggggtggtgaataattagttgaccaaaatttgaccaaaaaaatttcagtttttgatccggctgtaatagtcatcaaacttttcgattttctcgcgttcgatttttttcgagatatggctgtatacatcagatgtaatttggatgctgccatgtccaaggcgctcctggatgtattttaaatcagctccggcttccagcagaataaccgcatgcgtatggcgcaacgaatgaatcggaaggggaggaatgcctgctctcttaaggatacgggaaaaggcattaaacaggctggacttcggcataaaattcccatcattacggcacaaaaccaaatttaagtcgtggtgatatatttcgttcagggcgagcttattttgattttgatattttttatggaaagtcagatcgttaatcaggcccttgctaattgtgatcacccgttttgaattgtaagtttttggatcgccaaacagctcttcttttgattttgcctgaaagtccaatgttttggtgatgctgatcgtaccggcttttaaatcgatatctgaccattgcagagcggctgcttcgccttttctcatgccagtttccagcaatacattgaaaaacatccaataaatataatcatacttgtaagcttctttcaaaaaatcggcaatacggtcggtttcaatatatttcaaatctctttttttctcctgcccctttacaatcgccccaatgcatggatttttggtaactttccccaagatcacggccttctcaaatgcattaaacaaagtgctgtgtacaatttcgactgtgcgtttgctgtaaccttggtcaattaactgatttagaaatttttgatatagaatcggcttgacgttggccagcttaatttccttaaaataggggagaatatgcttttcgatattctgtttatgaagattgaaagtattttttcggatcgtatcttttttaaactcataaagccaggtgttcaaaaagtttttcaaagaaataggggactgctcaacaccttccaaaatttcattctccattttttgagcggctatctgcgcttctttttttgttgaaaaaccggattttgactttattttatatttttcagtgacggggtccttatatgatatccggtattcccatttgtcgccgcgttttctataagtggccatgttcatttctcctctctaaaatgactttactctaccaaaaaatcagtcccaatgaaatgactgggtaggtacagattgacggaaataaccgtttcgctgcagctgtagcagccgttccaggcatagctccggacttaccttgaatatgtctgtcatttgctccacaacatgtggatcatcaaaattgatgtattgcagcatgtgaaaggggatagcggcatactttacgaaatgccgtgcatcccactcctgaagctcgcggaaagccttaggcatcatcgactgtacaccggcatgccgtaaaatgtgacaaagctcgtggaaaaagatctcccggtgcttctcaggcggctcccggcaatcaataacaattccctggtaacggccaatcacttcaaaatacgaataaatcggcttataatggacataaatgcgcaaacaccgggaaattgccgtaatgtcgatttgcttcggtttggtaataccgattcttgagtaaaattttgtaacccaatcttctaaagaagttgtgcagtaatcatggaatttcacttcaatcacctcgcaaaaacatatgttcccaattaagattataaaataaatctccttcaattaaaagaaggagatttagaaataattgaacaatcttatcaatattaatttgacaactcatcgtaaatggtaacaactttgatgtttgtctcaattacccatcttaaaatttcccgggtagaattataaattaacttttccgtaaagatgacttcatttgaaggatagctgtgcttaaattcaacaaaaaatttatcttgagtttcggaaactatgatatccacaacccgaccattttgcgattgaatttttgctataatatctaggtaatgaatattcgggcgaaactttgtatttttgcatactttcaatttttactcctccttattttgcccatattgttttaaccaaaagctaagtttatcaacaacccgttgtttcgctattgcaaaatctgtttggttatatgctgaaacatgttttttagaagcactatataatgactgtcttatgtttcttgaaatatatcctatattatttacttcttgtttgtcaactgaaggatcgtctttgaataactcaaagccctctttattaaggattgatgagttaaaaaattcctctaactttatattaagccaatttgtaaaatcttccctgagcgaatcagaaataatgaaatcacgaaaatcggaataattggtgttaactgaatgttgtgttgcttcttcttttgttttaattagtaaatcagcttcaaattgatctaattctccttttcggaccctctcgaaaacgctttgcttataatcatcaagttcctgtttctcttgttgtaaaagtgcctctaattgttgtttgtaatttttcataccgtcctgcgtgaaagaatcttcttttcccaaacctcttgacgtcattgaagaaacagataaaattttttgaatagaattaaagaagtcgtcatcactttcatttcttgtgttgctagcattaggggaaggtcttctttctacaaatcccaactcatcaaaattaaaagacaactgctcaaataattttttgcgttgcaattttattttttcaccgtaagtctcttgttctttataatatttccataattgttctaatccaagctcctgatggtaaacaacattacaataattgtcaattggatttagattctcagcataaattctgcgtaatcctcttccaatagcttgggcataaggacttattgttttaaaaggcctaaataaggaaattattgatatatttgggttatcatatccttctccaagcatttgaatgctgaccattacgtcataaacaccatttgcaaaatcatttaatcttttttcaatttcattttcagataggctttttgtacttacataagtagccttcagatcatagtcattaaaccatttacagatatcttttgcatgttcatcattacaagttacagcaagaacttgatggttaggataacttttcctcttttttagcaatatatccttagtcctttcaattacttgtttggaacaatgttcatccattgcaatttgtttgcttacaaaatcgtttcctaaaatttctttggctttctcaagagaatagatttgcccagtaacttgatttttcaagataatttctccaggtatttcttcctgcttaacaatatttttaattaaaccatcatttattgcttctcctagtgtatattcataaattgggtcatattcatttgttgaaatggactgattgtcacttcgaaatggagtagcagttaatttaatcaccttactggcggaaaagtactccagtgcttctttccacatattagctgcaacatggtgagcttcatcaacaatgatcatgtcaaaaaagtcttttttaaccaaactcattaaatttacttcgtcattgctactcccaagtttatgcacgttagttattacgatgtcagacatcgtaagctttttcatagtcaattctttttcaccatctatttttggattgtatcccttatataagtaagaatttggaagagcttttctatcataaataacatttctttttatccaaaaagttctttccggattttgtgctgaatcgaattgttcatatactgtcttgcgaacaatttttcctggagttattataagaactctaccttttgatattccatatggcaatatagccataacgcctgtttttccagttcctgtaggcataacaatcaaagtttctctaaatttaaaatcaggaaactcttgataatgagcaaatgctgctttatatgcttgtttttgagcttcataaagtgaattgttattgtgaatgttggcttgagtactttgaaatttgttcaaataaattacccccttgtatatttttttgaaaaaaattcaattgttttatacatacgccctctgcatttccaaacaatgctgataaagttcccctgtaaccagacagtcactcaacgcttcgtgggaagagaaggtgtcaaggccgagatattgttttagggtctcgagtttatggttatccgtgtttttgatgtgccttcttgcaagggtgagagtatcgacgactctaaatttttgataaggcagattttcagcatacatgttatgtagcaagaatttcatatcgaatggcgcgttatgggcgactagtgtatcagatccaatgaaagaaagcaactcgggcaatttttctttgatggacggtgcgccgattaagtcatcatttgtgatgccggttatcctggttatgttcgtagggatgggcacgtcagggttgattaaagtgacgaattcatcaatcttttgatggttttgaaatttgacggccccgatctgaatgattttgctgttttctggtttcaatccggttgtttcaaaatcaataacagtataattatccggataaactctcgcttttgtgtatttaaaataatcggctttgctgacctttgtcatgttccttttggcgggcgccggcactatgttttcaacaggttttttattctcagtttttgcgctctcgatttcttttttcagtgcagtaatttcagtgtttagcatgctgatttgcttttcgagtgcatctttttcttgctgcagcttgatcgtatcccggacaacattttcttttttcagtttcaactgttgaatctctcctttgattggatctggttcgtgggtggcaggcttggactgctgcatatgttttttaaaccttttgattgaaacagatcgcgtgattagaagaatgatagagataaaaaggaagaagacacttgctttccaaagaacagccaacaggcagatcagccagggcgaatgataccatttttctttatagatattcatgtgaacccccacttgtaaatttataaattttaataagtttcatcccaaaagtcattttcatggacaatcacgataggggagcctgcttttcttagttgaacggctttttcaactttccggccatagcaggagtaagcccaacatggattgccatcagctccgacaatcagataatttgtctttttattgacgttattattaaagattccacctttgttattgataacttcggcgatttcatttcttgttgctcgagcagacgtgccggtaaaggaaaaaatcttattttcaaaagtgatctctggacaaacagcacaaataccattaattgaaaatttttcttgcaaggaccgaatctccggttcatgaatattatgggagagtttcgtgtcaataaagttagcaaaaaacgcggtcaacatgcttttttcttcttttgtaacgaccccgtcatgttttactgcagttagtaagctatcgatttcgtcaaatgggtaggtacctttcagaagaaaactatgattttccatccattcttccaactggtcaatttcagtatcatccaatttacgatctgccagcatgccatgtagaataccttccagttcttgaatggacacggtgactaggtcataaaattcatcaaactcgtcctgatggagaatacgattgcaaagccattggatatcctgaatttcttcttcgtcgagctgaccatcatctaaaacgctatcaatcataggtatgatttcattaaacggagacttgttttccaaatgccgatgaagattgcaccaatgaaaaacttcagccagttcttcattagtaataatgccgtcatattgaatacctctgatcagtcccataagagaattaacagctttatgtaattcagcttttgttgtatacatacggtattcattgacttcggaatattgttttcccattttaccatttccccctggtcaaaaaatttgtgtttcgaaaaagcatccaaagccaaaactctgaatgcctagtcattctcttttaatttacatatatgttttttaaatttttgtttttgggtcgtcaactaatccgaaggcttttcatcattccgttcttttgctttctgggcaacccattcaaaatgccgcctgatttcatcaatatcatcttttgaaagattcttccatttatcaatgtcaaaaaagccaatttgctcaatgccatattctttaatcagtttgttgatttcagccagtgaatcgtttttgtgctctgggagatttgactttacagaattgtttgtagtgtcttccccctttattaagtaatcaattgagacatcaaagaaggaggcaattttttccaaagtttcaaagtcaggttgagtttgtcccaattcatatcgtgcataggttgaacgattgatgtttaaggcatcagccaattgttgctgtgacaaattccttttatctcttagtctttttaagcgatctccatatcccataatgattctccatttccatttgcctatattataagtgaaaaatatgcacattaaaatatttgtgtaaaaaatgaacaaaaactattgacagtgtaaaaaatgcacattataattggtgtagaaattgcacaaaggtggtgaagtaatggaaaagaaacttctggttcagcgccgtgaactgctaggttactctcaacaggatgtagctgatctagtcggtatcgatcgctcttactataccaaaattgaaaatggcttgactccgagcgtaaaagtggcaaaggctttaggctatcatcttggatttgattggacatttttttttgatgatgattgtgtaaaaaatacacaaaaatccaaggaggtgagctgaatgaacaacgtgttgctactcttgaaaagaacgccaccgtggccaccgcggcaacggcggctgtaagaaggtgaatgtgttgaatttaaactcgttattaacaattctctcttgggctatttcaattttatctcttcctattgctgtgattgtgatggttcagtacaagaactaattattcggcaggaaggcaggaaagtccataaatattctatttctaattcagaaaataccacagcaagtcgtcacattcctattaatctactggtacaaagggggaaatttcaaatgaagctgggaaaagaaatggcgaatgcccggaagcggaaagggattacccaggaaagtctcgcatcgaatacgccggtttctcgggaaagcattgccaaatatgaaacgggtgccaggacatttccagatgatttgcgttcggtaatggccaatgagctggatgatgtggaattttactttctggcctggtgcgatgctgcaggaaaggtgtcgatcccatatttcaatggtgaaaacatcgatcatcatccgacaagcatggcttttctggtgcaggcagaaacgaacgaggcgttggataaactgcaagacattccctgggcaaaaccggtacatacacgaacagcacaagagctcgaggaaacgaagaaactcattttcgaattactggatgcggcagccagcatggtcaatcttgtaggggtgatatgtaatgagcaccaattttccatgaaacaactttttacgcagtggcggctgtctctccgatctcgtaattacattgataaagatttttaatgcaagaggtgatgccaaatgtccatgttaaaagttgaaatcgatgaacaggaagtacggaatctttacctggaaagaatcgaagaaaaactgaaacaagtggatgcagagcttgtgttttgggattcagccgagctgaagcgtcgcactggtatgagctggaacaccattctaaaggaatttttctacgacgaacgctttccaaaatacaaagttggccgagattggcgcttcccggcggaagaaacaaaacagtttctattaacttggctaaaagagcagccgagacattgaggaggaaatgaaatgttgaaagttgaccaatttttgcggcaggatttggccaaggcaatcgttgagtacaaatgcgcatttgaactaagcaaagaggctacagcattgctgatccgtgaaaatgactttgaaaagagcatccagtatacggaagatctgctgaaatcgcttaaagcattgcagaagatgaaagagaaaagggaaatgctggagcggatccataaggtggctgttgagttacaacaacaaaatgttgatatcaaaacgatcgttttgaagaaagcaggtatatgagatgggtggcgtattttttctaattttgtttctgccggcgctgctgatcggttatggcgtactttgcgcgtgggtgggtgatggagatgaatgaaacggattttgatacgctgtgggcagattttttggatgtgccaattgatttggaacatcaaatagcagttttcccttttttcttaggccgtatcaaggctttattaaaaaataaagaaaccatttcgaaagaagaattatgtgatgcgttgaaaaagtcaattcaacacgcaacgtccatataaccatatcggcgagaatccttattcttgccgtgagaggctgaaatagggcctggtaacctaggaattatttccacaaaacccggaaacctgcattttcagcgtctcacggtgcgaataaggcactactgatctttgacaactgaataaagaggaggtggaatgattgacgctcaccaggaaagaaaaacgggagatcaggcttgaaatttgccgtaatatggacctttattgcaagtcttgcccaattcgcgggaacaaaaaaatcaatcataacacgatttattgccggaaaaactgcctggttggtgctcttctgcaagaattggcattcaaacttatagaggatgaaaagcaactggatcacagcttggcgaaaaccggcacttggacggaagaagaagatttttacctcatccatcatgcaagcttatatgatgacgagcaccttgcaatgcgcttgaaccggacgccggtttcggtgcataggagaatgattcatttgaacttattagaaaaagtacgcaattaaaggagggaaaccatgggtaatttgcttctggatgaaagaccaattattgttattccttcattggctgaaaaaatcggcttgaatgaggcaatcatcttgcaacagttaaattactggctgcaaaaaagcaaccacatctatgaaggaaaaccatgggtctacaacacctatgaggattgggaagagcaattcccgttctggtctatcagcaccatccgccgggctatttccaagcttgaaaaggaaggattcatcattacaaacaatttcaaccggtcacaaattgataaaacaaaatggtacacaattgattttgaaaaggtggaggggttgaacagtccatctgttcaaaatgagcagtcgactgttcaaaatgaacagacgattgtccaaaatgagcagtccatctgttcaaaatggacagacgatgtgttcattttgaacagaccaataccagagagtactacagagattacttcagagattacgacagagattacttcttcttcttcggaagagtgcattccgaaaaaagacgaagaagcaaaaaaggctattgcgttttttgaacaaaatggctttggtgtggtcggatcttatgtcgctgaaaaaatttatagctggtgtgatgatctgtcagcggatttggttgtagaatcgatgaaaaatgcagtggagcgcggtgcaacaggctggaagtattgcgaagccatcctaaaggactgggcaagcaaaggcatacagaccgttgagcaggctcgtgcattgcagctgaaatacaaggaagagcgatccaggcaaaagcgttatggaagcagatccgggagaacggagagggtgcctgactggtttggaaataaccaaagcagtagcagtattgctgagcaagaatcccaagaagatcttgaggcaaagcggaagcgattggagaagatccgggaacagtatcgaaaaacagagagggataaggaatgataaatcgtgtggttttaaccggtaggctgactgcagatccggtcttgcgttatacaccaagcggcgttgctgttacgacatttacgcttgcggtgaaccgaacattttccgtccagagtggcaaaaaggaagcggactttgtcagcgtgattgcctggcggaagatagctgagaatatcgcaaattatttatcaaaaggcaacctgatcggcgtggacggacggctgcagacacgcagttatgaagacaataatggcaagcgggtattcgttacggaagtggtctcagaacatgtgtgttttctcgaaacaaagaaaaataggcttgcaaatgaaccacaaggaagtcaggatctgccgccgtttagcgacgacaatttgccgttttaaggggtgaaaaagcatgcaggaaaagcaaattgaatggcaaaagcaggtaatccgtgaagaaatgcatgattacaggaaaacggatgaacagcctgtaaaaaaggttgaaaaataaaaaagccaggcattttcagcccggcgaaaaaccatatcgacgcaatcattatagcatacacaaaaggggcgtgtcgatattggctgaaaagcgaattggagaaatagagcttttggaagacttgacgattaaacaagccattgaaccggataaagtgatcatcgttgtcttggacgggaagcgcggaattgcccgcaaatgtgaagcagttgagcatggtagcacgatcatcgagacagtgaatgggaaatcgaaaaaaattacgtttatagagtcctatcttacctaattcatagccgatttagcttttgtttaaacctattatgatattttgcatgtaccaataacagagaaatcgcggtacaaaaatacgctgcagggtcaggaccgggatcttgcagcaaagggttggtgttgaaatttgctacggaaaaaacctgtcgacagaaaaatattaagccaaaaagaacggcttttgctgattgaatggctatatgtaatcaccggtttcacccggtcgttttggaaagaaaagagcgatgcagaaattatccgtttatatgagtccaatcttgaaatgaaccagatggaagatgagtttgtaagatgaattggttggtgaaatgctatggaggccaaaattatcatcaaagacagccggaagaagtggatggtggaggaagatagaaaatacgtttgtcaaacgttctgcaagcagcacaaacgatgttcaacccgtttagggtatgattgcaaaaaatttggcggtgacagaataccgaaatttaaaaaatgaggtggaacatctggggaaaaccgcaagattaaaaagagaacgggacactgattccgttctcttaggaaagggatgttttgacgtgaatgaattggaaaacagtattaatttccttaaagaacagctcattgctgcgggagaaaagtggaaaggcggcatggatgttgaaccaatgagagactgtctggcaattgttgaagccatcaatgtcctagaagaaagggcatttggcaggatgattacaacgatcgcttacattctgtgaggaggtgggataacatgcaaaatgttttggaatttgaagaactgatgatcaatattttagacgaaccttcaaagtttaaatttcatttttccgaaaacgggattaaaattagcgcttggattaaagaagctgtgaatttaggaaacgggctgtgcattgcatttgatggcggatctctgctcgtttggaaagataaccgcgttgtaaagtgcagacgaccgtccgatttaattacgtattgtgagctttgcttttcggtttttaatgaatttgatgagaatatcggttatctgtatgtgcctgcgcgtaaaaggtgatctatttgagacatcaaagtcaacggataccaacgcatgattatctcggcagaaaagtatggattggcgaaaaggcaacactatttagtagcaatggggtccattatgaagggacaatacagcagatcggtggcaaacgctggtttgtggtgaatgaaagtatgcgaattggcggtataggaagcttgtacttgatgaaggattgaaaggagaaatgaattttatgagtgaatcatttaggttatataaagtcgtggaaacggacggacaaagtgctgaagaactgcagaaagttttaaatgctgcaacggatggttttacagaaatgcaaattgatcatgtcgttgggacaaaaataattcttggctacgattcacctttaaatgcaaaaggaagagctgaaatgtcagtaaaaaaagctataggctctcaagcgaaaagtagttttagaccaatatattaaaccatcatagactatgtcgtagtacgggtatattgtgtgaaatgaaaacatgaggtgattaaatgaaccagattcagcaagtatttggttatggaatgagccaactacgaactgtgttaatagatagtgatgtttggtttgttgccaaagatgtatgcgatattctggaagtaagaaacactacacaggcaatcgctagacttgaagatgatgaacggactatgttaaacataggtcgtcagggggcaaccaatttagtgaatgaaccgggtctatattcactgatcatgtctagccgaaaaccagaagcgcgtgcatttaaaagatggattacacatgatgttattccgcaaatccggaagacgggaagttactcaacacaggttccgcaaacattcagcgaagccttgaggctggcggcagatctgcaggaggaaattgaaaaggcaaaacctaaaattgagtcatttgatcgcttcatttccggaaaaaactatcaaaaaatgggggatgttgcgaaaatattaggatatggccgaaataactttttcaagctgcttcgggagatgaagattttaatgagagataatacaccttatcaggagtttatcaaccgcgggtatttcgttgtgaaagaaaagccgatacagatgggcagccacgtcattaataagccccagacctatgtcacggcaaaaggtatccattatattgacaaattattgaaagaacgatcaataattgtataatagaagtagaatatgtccaagtaacggagaagcgtgcggacactgactttcagcatttgttgctgatggttggtgtccgtttttttattggaaggaggaacaatgatggaacaattgagttttcagctggcagagattgaccgggaagagacaaggaagcgggtggaaggtgcattggaaaagtatagggttttgttgctaacgcaggaactggaccaggtgccaaaagtaacctcaagctattcattggttccaccaagcaacaccaaccagtttcactcctcaactgaagaagctgcagtaaagaatgtggactatgaacgcgagcggagcgattatatccgtaaagtttccatgtccgtaaaccgtctcgggtttaaggagcgggcaatcctcatccgccggtatatgacggaggatgatgtatttgattatgaagtgtacaacgaactgaacatgagcgagcggacttatcacagaataaaatctcgggcattttataagctggcatttgcgttgaaagttgaagtctataaagagaaggagatgagtgtatgaatgtcgtccaaccgattcgcgatcccgttaagatagagaagatgaagaactatttgaaatcaaagagtgaaaggaattatattctttttatgttgggaataagcgtcggacttaggatatccgacattttaaaattgaagaaagaagatatattaagaagccatattgatattaaggaaacgaaaacaaagaaaaacaaaagggtaaaaatccccggttacattaaaaaggagatcataccttacgccaaaacacttgcagacggcgattaccttattaaaagccggcagggagcaaacaggccaattgaccgttcaacagcttataggatactgcgtgatgctgctaagcatgttgggctgacagacatcggtacgcatacattaagaaaaacatttggctatcatttttacatgcaaacaaagaatgtggccctgctgcaagaactactaaatcattcgagaccggatattacgctacggtatatcggaattaatcaggatacgttagataaggcaatggacaaattcaggatatagtccttttctttttgggcatcactacatcataaaaatacgaggcgtgcactcatatttatatattgaatgaaggctgttatttcaagggtttcaacgtttgcccgagtgcaacagtctatgtattatagtgtactcaatgccattatttaagagggatatgtatgaggatagaggaagcaagggaagagattaaaaggattgaaaggtttatcagtttagtagaaagctatcgaccgcagtcatttgagcaggaagcgatcaagacgtatgtgttaattgaaagtgttaataagacagcggcagtattgaatgagaaaggatttagaataggtaaaaggaaagtttcaggtaaggacgtatctgatattattcgttctaaacctgatgatgagctgcatcaaatcgctcacgatatgtttaaatacaataagaaaaaagctggaaaaaggggttggtgttgaaaaaataatggcaggattttggcaggataaaggcagagcattttcttttgcctgtgttacattaataccatgacaagtaagcgaaggaatcgacacacagtcggttcctttttattttatcgattgaaggtgttgaccatgaaatctaaatccagagagaagaagcaaaagaaactgcggcgtaaagaattagaatacctgatggggatccatcgtgacaggtatggccgacatcatggtgcagttcgcaggaagtgaccttcaataactaataaagagacatatggacacatataagaaggtgggggagcgataaaaaagaaatggctgactttccaagtgccaggattagaccggaaagaatttatgatatgaaggctaatattaaagatcttgaaccagaacgatacaactatctttttaataatggtttattgacaataaatgaagtacgaacatttgagggacttccgaatattggtgctgaaggcaataaattatttaggcctttaaagaaaagaagaaagattccttttgggtgatcagcatgccaggcaaaccactgcggccatgtgcaaagtccggctgccgcaatcttaccacgaacggctactgtgatgagcataggaaagatactaatcgtgaatacaatctgacacgagacgagcgggtcacgcgcttctataagtcgaggcaatgggaaatgacaaggaagttggtgcttgttagagaccatggtctatgccagatgtgtctcaaacatagaaaaatcgtaccagcatcgcttgttgaccatatcattccggtacgggttaattggagtttgcggcttaataaaagcaatcttcagtcgctttgcgtttcatgccataatgccaaaacagcggaagacaaacgaaagtacggaaaccttgcatgagggccgggggcccctaaaaaagtacggggtgggccgtctgccgaacggcgtccactttcgcgtgaatttttttcgcaaaatgaaaattttttaagggggtgattggaatggcgggcaggccgtcaaaaccagtacagctgatcaaaatggaggggaacaaggatcgccggacgaaagcagaacttgagcaccgagaaagttatgaaaagtccctttatactggaacaaagatcaaagagtcgcccgccgtcaaatctgatcctgttgcccacaaagaatttttacggctgaaaaaactttataagagcatccagtacattgacggcttggatgagcagatcgttaaccggtattgcatgctgataagtgaggagcgggcacttcagaagcaggccgattctttgcatgcacttcttgaagaggaagaagatccaaaagaaaagattgagatttacaaactgctcaacagctgcgataccaagctaaccaaaaagcgggacttgatattgaagattgaggaccgtctttttctgaatccgactgcccgcatcagagccattccaaagaaacctcctgaagaagagaagcaatctccaatggctgaatttttaaagaaacgcgcgggtggtagccgtgcggattgataaagcaagagccatggagcccattgagttcattcaaatgctgaaactggttgacgacttttacggtcagccttttgttttaatggactggcagtatgaaacgatctgggatgtttatggcacagtgaatgatgagggatataggcagtatcggtacgcttatttggaaattccaaagaagaatgcaaaaacgacgttaatcgccggcctcggggtttatcacttaacatgcgacggtccccaagggcaaatttattgctgcgcagccgaccgttcccaggccagtctggtttataaagcggctgtcagcatgattgaccaggatgacgaactgaaaaagctgctgaaggtgacggagagccggaaagaaattgtaaatgtcgagacaggcaccatcttaaaggttctgtcagcggaagcatacaccaaacatggcattaacccaacggtcgtcattttcgatgagctgcatgcacagccaaaccgtgatttgtgggatatcatgactttcggcgccggtgcggcccgtaaagaaccgttatggtggatcatcacaacggccggcgacgacccggaccggaaatcaatcggctgggaaatccatgagcatgccaggaaaatacgggatggagaactgtcggatccgacctggtatgtcagaatgtatggtgctgatgaagatgacgacatctttgatgagaagacctggtacaaagcgaacccttcacttggccaaacgatcagcattgaatctgttcgccaggaagcgttggcggcgcgtaacagcgaagcatccgagcggctttttaggtggctgcggttgaaccaatggatttccttaaagcggaccgggtggcagccgttaagcttgtgggacaagacggaagggaattggaacctatccgatcttgttggcaaaaaatgttatgtcggacttgatctttctagtacgacggatattactgcagcatgctatttgtttccgccacaggacgggatcccggaatggcgtgcactttatgatgcctggataccggaagacaatatgaaagaacgtgttgcccgtgaccatgtgccttatgacaggtgggtgaaccagaaatatttgacggccacgcccgggaatgttgtggattatgattttgtccaagcaaaaattgtatacgcaagcaaacagtatgacctttccgtcttgggcgcagacccatggaacagccggatgctgacgcaagggctgatgagagaagacgtgaatgtcgtggagatccagcaaaccatggcgcagttgagccccgccatgaaaatgattgaacagttgatgaaaaaaggcctgctgagccacgaagtaaacccattggcccgatggtgctggggaaatgtcgctattgcggttgacggaaatgagaatatcaagccaatgaaaaataaatcacaggaccggattgatgtcattgtggccatgattatcgctatggcgacggctatgctgtttgaagaagtcagcctggacgtttcagaatttgcaaatgaagactttcttgacaaactgtggagctaaggaggtgagtgggattgaatgagtttactcagcagatttaaaaggcaaagggtcaaaaactatcatattgatgatccgaattggttatcagaatggcagacactggctgattttttaggggttagcctggacccgtctgatgtggacgtccggggaaaacgggcgctgaaagaaattacggtgtatgtatgtatcaaaattttatctgaaaatatttcaaagctgccggtcaagatttaccaggacaacgggggcattaagaaagtggccgggcattacctgaatccgattttgcggttaaggccgaatccgtacatgtctgcatcagatttttggaaaggtgttgaggtgcagcggaatatatatgggaacagctatgtttggattgaatatgcaaaccgcggccggaatgccggcaaggtccaggcactttacttgctggatgcccagcaaatgcaggtatgggtggatgattccggcttaattagctcaaaaaactccatctggtacgtctatacagacaatgcaggggtgcagtacaagcttcaatcaactgatttgctgcattttaaagccatgacgactgacgggatcgtcggtctcagcccgatctatacgctcagaaatatggttgaaaatgctgcttcagctgaaaaattcctgaataacagctataaaaacgggatgcaaacgactgggatcatacattataccggagatctgaacgaaaatgccaagaaaaagttcagggaaaaatttgaggaaatgtcaagcgggctgaaaaatgctaatcgtgttagcttaatgcctattggctatacctaccagcctctttctcttaaattaacggatgctcagtttcttgaaaacacgcagctgacataccggcagattgcgagtgcattcggcattaaagcacaccaactcaatgatctagtcaaagccagctatgcaagcacaagtgaagcgaaccgggaattttacgtagatacactcatgccgattttgaccatgtatgaacaggaattgacgtataagctgtttttggatagtgaactggtaaacggattttacgttatgttcaacgcagatgccatcctacgtggagatttcaaatcacgcattgatgcggcagcaaccggtgtacagaacggcctgctcacgccaaatgaagcaagggcacttgaagaaagagagccgatgccgggcggtgatcagctggtcatgaacgggaattatattccgttgtcgatggtgggcgagcaatataaaaaaggtggtgataatacaaatgggcaaacataaattttggaattttataaagaatgaagcggaaaatacaggtgaactgcagctgtatggcgaaatttccgacacttcatggtggggtgatgaagtcacgccgaaagattttaaagcagatcttgacgcgcttggcgatatcagcacgttaaacgtctatatcaattccccggggggcgatgtatttgcaggacaggccattcattcgatgcttaaacggcattctgctacagttcatgtttatgttgacggtctggcggcaagcattgcctccgtaatcgcaatggcaggtgacaagatcatcatccccgaaaatgccatgatcatgattcataatccgtggactgttacggccggtaatgcggcagatttgcgggaagttgccgaccgtctggataaaatcaatgaaaccatcaaatcaacctatttatcaaaggcaaaaattaatgaagcgaaattgacggaattgatggatgctgaaacgtggctgtctgcacgggaagcagttgattacggatttgcggacgaaattgaggatgcaaaagactatgcggcaagtttgaacagcagatttctcaatttctataaaaatatgcctttagacttgcagaagaaggcaaaaaataaaggcgaaaaacagaataagaacaaggaattggagctgtcgaaagccaaactggcgcttgagatggctcttttaatttgatgggaggcaggaaaatgagtaaagaactcagggaattgttgaacaaattgaataataaaaaggcagcagcaaaggctttaatgactaaagagggtgtgacgtcggaagaaattgaagctgcgactgcagaaattactgaattaaaggcaaaaatcgaagcacagaagctaatcgatgaagaaacagcgataccagtaggtggtaaaccggtcgtatcggtaattgaacctgacaaaaacagcaaggagtaccgcgaactgcacacaaaagcatttctgaattacttgcggaagaagccgttgaccgaagaaatgaagaatacgttgagctccaacaccggatctgacggtggatatttgattccacaagatattaatacacaaattaacaatttgaagcggcaatataaaagcgcaaaaatgtgctgcacggaagtttacacgacttccaccaaaaccggttcgtttgtgtgggaagacttgtcaacactaacgccccttgtcaatatgacggaaatgacagacctggatagctcttcacagccgaaattccggtctgttcagtatgctgtaaaagatatgggcgcaattcttccaatcccaaatacgttgctgcaggatgaggacgcgaacttaattgcgtatattgccggctggtttgccaagaaggccattcgtacggaaaatgccgatattttcagtgtgttgaaaaccggaaaaacaccggttactcttccagattggaaagctttgaaatcaaattataataggatgctagatccattaattgcagcaaacggatatttctgcacaaaccaggacggatttgatgttttagacagcgcactcgacggttttggccggcctgttctgcagccaaacccacaaaatccgacagagatgctattcttgggtaaagtcgtccatatgttctcaaacacggagcttacatctgatacggacaacaatgttgcaccaatctttttcggcgatatgaaatcaggatgccgttttgtcgaccgtggcacatatgaattaagcatttccacagaagcatatttcgtcaaaaatgcgactgcagtccgggttatcgaacgatatgatgtcatcaaaaccgattcggatgcttatcagtttggccagattgctttacctgaaagctgatcaggtgatgtaaatgattatagaactaaatgaagcgaaagattggctgagagttgacacggaaaatgacgatgccaggatcacttcattgatggcagcggccgaacaatatttaaccaatgcgacggggaaaacatttgacagcacaaatgaacttgcccgtcttttttgcctgactctactgacggattggtacgacaatacaggtttatctggcactgaaccgagccagcaaatgcggccgattattcagagcatgctgctgcagctgacctattgtgaagatgaggtgacataaaaatgccgatcaccagtcctggaaaaatgaatgaaagaattacgttttataaagaagttgtcaaaaagaatgattacggagacaaagtaaaagatgaagaaaaatatttggaatgctgggccgccgtgaagacacagtttttaagtgacatccaggcaagcattggcactgtcttggaagatactcttacatttgtgatccggcatcagcatgacaaagaaattacaaacgatttatctgtaaaatacaggaacagcgtttatgaaattatcaaaattaacccagatgtcgaatataaaaaatttgacacgatcatctgcaaagaggtgacatgatgagagttgaagtggatatttccggaattgaagcgggtttgaggcggctagctgcgaaggaaaaaaaggtgcagagggctgggttaaaaaaggcggcagaagcaattgctgaccggttgcgtgaaaacacgccttattatgatggcaaacgcgacgggaaatggaaagcacagcgtcaattcgagaaagaaacagggtcaaataatggcgactttgcgcatttgcgggatgacatcaaaatttcaaatatgaaccaatttggtgaagtctttgttggatttggaaaagaaacctattggcgtgtccattttaccgaaatgggtacgattaaacagaaaccacaggcgtttatccagcgaacggaagaagaaatgcgccggaaagttatggccatcatggtaaaggagtttaaaaggggtctgggcttatgacactgcctgcaaaagcagtctacgatattcttatgggcagtccggagattgcgaacatgatgaatagggacatgatttttatgatcgatgttccggaagatgatcagcaagttctgaacgcacctatcattcgaataaatgaaatcaacgactatcaggatggatttgcttcaaacaaaccgttttctgtttcttttagcgtccagattgatgtctgggccgccacgattgaacaattagctgtttttagagacgtgctggacaagatcatgacagaaaacgagtggggtcaatatacaggcgtgattgacaaagatccggatattgatctgtatcgcatggctcggaggtatcgggctgttcaggtgattcactttaattagggagatgagaaaatggcgactttaggttttaaaagtgtcgaatttgggatccatgacggggacacggaaattgttaagaaaatttataaattagatgccaatgaaggtggcacaattgaagcaaaattaagcggtcttggtgcgcaaatcaatgctttatatgcgtctaatgtaccgttttttgtagatgcaagcggtacgggaacgccacaattggaattcacagcagcggacttgagtgaagaaatcgctgcgtccctttcaggcgctgtatacgaaaatggcattttgaaactcggaaaagatgcgaaggcaccatatgtttctgtactgctagaagcggatggcattaaaaacgacagcatctatatcgcactgcttaaaggaaaattcgggcatccggatggtgtcgatttgaaaacgggtgatgacaaaggcaaggaagccgatacaactgacagtgcactgaccggacaatttgtaaaccggaaattagatggctttacctatttcaaaactcgttcttcgaatacagactttgatttgcagacatttcggtccctcgtttttaatggatacaatgaaaatacgcaaacggcaactcaacaaactgctggctgatagctgggctcttaggcccggctttttattttgcataaaaggagatgctggaaatgttaaaaattgaactttataatccggaaactgaaagaactgaaatctttaccgaaggattcgtgccagcaagaacattgcggaaagtgctggaattcgcggataagcaggaaagagaaaaacccagtgagcttgagacgttggatgaaatggtttccatgattgcaagcttttttcgggatgatcgggtgacctttgatgcgatctatgacggaatcccagcagacaaattgagtgatgaaatggaacgcattatgaccgacattatgggcggtgaagctaaaaaaaagctggggaaaaatcgaccaccatcaaagaaagcataaataatctgcacaaaatgtattcggagttaatgaaaaatggatggacgttcagagatattgaagaaatggacatatatggatttctgaatgtcatgaacgggccggacagcaaacagtatgacgatatagaagccttctataactcaatttgacgggaggtgaggaaacatggcaggagaccaaccccttggcaatatggtgatcggcgtcagcatggagggtactcagttcgcaaataccttgaaagaaatacgggggcaggtgcgccaagctcagagcgcaatgaaagccaatttgacagtaattagtggcgccggcgataagtatgaaacgctccgtgcaaaagtaaagagtctgaatgaagtaatggcggttaaccagcgcgaaattgatatgctccgtaaaaagcaccgggaagccattaaaacttacggcgaaggctccgagcaagtttccaaattagcttcccaagtgaataatgcggttgccaagcagtcagcctggagcagacagctggatcaagcaaaatctaaactatcggggatggatagcccaattagcaagttttcatctcggctgaatgacatctctgagcgggccaaaagcgttggcggaaaagtaaaagaaatgtctgacgggattacacaaacttttgcaccggctaccattgcaattggagccggtcttggtgctgcagcgaagcaggccatggattttgaaagtcaaatgagcgcggtaaagtctgtcatggcgccggacgaggtaaaaaagtatgggggcgcgttagaggatcttgctgtaactatgggggccaagacaaaatacagtgccactgaggccgcgcaggggattgaagaacttgtcaaagccggcgtgaaaacaacagatatcatccatggcgggctctcaggggctctaaatcttgcgactgccggtgaactggacctgaaagatgctgccgagatcgcgtcaactgcgttgaatgctttccggaaagacaatatttccgtaacccgcgctgcagatctgctggctggtgctgccaacgcaagcgcaacggatgttgaagaattaaaatatgggttatctgctgtttcagctgtagccagtggagtcggtttaagctttgaagatactactacggcgcttgcggcatttgcgcagaatggtcttaaaggtcaggacgctgggacatctttaaaaactatgttattaaacctttccccttctacaaaatctgctgccgatatgatggattcgctcgggctggcagcgcgaaatacatcttctgcatacaattggttagttgatagggggattaaaccagcctcacattctgcaaatgacatagaagcttctttgcaacgtcttgcgaaaattcaggcaggtgctggagcttctgcaagtaaagtaaaaaatgaatatcaggaacttgcgaaaaactccggttttgcatcaagcgctttttacgaccaaaatggaaagctaaaatctctttccaaaatttctggtctgcttcatgacaggctcaaaaacctttcggaagaacagcggcaatatgcattaaaaacaatgtttggaacggatgctatcagggcagccaatattttgtataaagaaggcgccaagggaatcgaagacatgaacggcgccatgaataaaattaaagctgctgatgttgccaaaaagaaaatggacaatctaaaaggctccattgaacaattaaaaggaagtttggagacggccggaatatcggttggccaggcattaacaccagccattaaaaaaacagctgaatttgttcaaaatatcgtggacaagtttaatgccttgccgaaaccggtccagcatgcggctgccatttcagcagcgttgttagccgttattttaacccttgtaaccgggtttgggtttctgacatctggtatatccagcttggttattgcctatggtactctggccggcggcatggccgcaacgacaggagttatcgcggcagaaggggcagctgcaacggctgctggggcgagcaccggaatattggccggtgcaatcagtctattaacctctccggttacgctaaccatagcggccattgccgccttggcagcggtatttgtgatcgcttataacaaatccaaaccgttccacgattttataaatggcatcggggcgtccctgatgaaagcatttggttttgtgaagcaatttaccgtaggcatcatgcaaatgtttcaaggcaattgggccggtggggcagacatattaagcaagatcggcctatctgacagcgcggtacaaaagactattaatatcgtaacagcaatacagaatacctttaatatattaaaaggatatttgcaacaggcgttaagtgcagttggatcatttgtgatgagtaaaatcactgaactcaagatcttttgggatgcaaacggtgcatcaataattcaggcaacaaaaaatatattttcatttttagccgtaattattaaggcggctctagcgattctaactcctatttttaaaattggatttggagtttttgtcacaatcatcaaatccgtttggggaaatataaagggcattatatctggatcgctccaggttatagaggggatcattcaggttttctctggcttgtttaccggaaactggaaaaagatgtggcaaggaataaaaaacattttttccggcacttttaaggttttaatcaactggattcagctcaattttattggcaaaatgttgagagttgcacgcggatttgtcgggccgttcaaatcaattttttccggattgtggggcgcaatgaaatcaattttttcagcgccaataaaatggattggaaatatagttaaaaatggctttaatggcatgaaaaataaggccattggaattttttcatccatgaaaaatggggcttctaaaatttggagttcaatggtgtccacaattaaagggctccctgggagaatggcaaatggattaaagaatggcgcaggaaaattaaaaagtgccatgatatccgtcggaaatgccatgattaaaggacttggcaaaggagtaaatggcgtccgaaatggaatcaactggattcttgaaaaagtccacgctcctaagaaactgcggattccaaaatggaatgtaccacagtacgcaaaaggcaccgataaccatcctggcgggtttgcattgctttcggatggaaaaggaaaacataagcaagagcttgtcactttgccaaccggagaaagtttcttgtctccagtacgcgagaccataatgaacctaccgaaaggcacaagcgtgctgaatgccaatgcgactaatcaactgctgtccatcatgccaaaatacgcaaacggaacaggttggttggagaaggcatgggacgtaacaaagtcggccgcgtctaaagccgtatctggtgctaaaaatgttggaaaaagcattcttggcggcgtaaagaccgtatgggattacgctacacacccaagcaagttgattagtaaagcggttagtgcatttactaacctatctggattggcacagcctactctcgggatggttagcggtgcggtatcaatggctaaaaaaggcgctaaaaattggattaagagccttatgggcggcggcgataatcccggaggatccggtgtggaacgatggcggtcgtatgttgtaaaagcgctcgagatgaatggcctatccacgagcaaagctatggtggaaaaagtgttgcggcaaatcaagacggaaagcggtgggaacccgaaggccgtacagcacggttacacggatataaacgcgataacgggagatttggcaaaggggttaatgcaaactataagtgcaaccttcaacgcatataaatttcccggccataatgatatttttaatggctttgataatttgctggctgcgcttaactatgcaaagcatcgtcatggcaaaaatttatccggccttggcgaagggcacggatatgcaaatggcgggtttgtctttacagagcagcttgcccgggttgcggagggaaacaaaccggaagcaatcataccacttgatagacttaaaagaactagagcattacagctattatcacaaactcaaaaagctttgggagttggttcgcaaagccaaagcaactcatcagctgcggatttatctgctttaatccagcgtcaggaccagcaaatatctttgatgcagcaaacgattgatttacttatgaaaatattacagaaaaataatgtgattaaaattgatgcagatgcactggaaaaaaaatgtaagcaagcggcaagctgcaaattacaataacgctgcctatatgatggggtgattgattgatggaagaattaacaatcacaaaactggatggaacaaaacaaactgtaagcgaaataaatggtgcatatttgcttgatgtgatcgatagcggtccgcagccggcaaccacatatgaacaaatcgctgggtccgatggaaatattgataacggaactgcatttggtacaagaatcatcactgcaaaattttatatggatgcgaaagattacatcgactatacgcttgcccagagggaaacttggcaagcgttatttgatcatgatccatattacatcacctggtcgcgaatgcctggaataaggtttttagttcatataaaaccgtttgaattcgccagtataagccaaatgtccggaacctttgatattgaatttgaagctttcaaaggatttggagagagcgttggcagaacagatgaagatccaattgatatggatagtgaaatgtggcaaatggtcggacaagggtttgtgttggacgaggatttggtttataccgatatccatggaagtagtttaaaaatatttaacgctggagatatcacaattgatccacgtaagcacgatttgaccattagcatacaagggatcggcactccgattttgaaaaaccttacgaccggtgactcatttatttacaaaaaaactttggatagcggcgatacgctaacgattgacggggtctaccctttacttaacggcgcccattgtggcagagatacgaaccatggactcgtaactctattgccagggtggaataaaatccagctgaccgggcttagtaatccggtgtcatcttttggatttagatttttgtacaagtaggtgattgcatggatttaatcgttaataatggcatagatgaggaaatcctggtcgatttcaatgcggatgattttgcggaagaatggcagaagaatagcacatggtcagtaaattttagcgttacgaaaacgaaaagaaacgcctacgcattcgatatgttgcagcaagaagcaatgatctgtcttgatgggcaatggtttgtaataaagcagcttgagccaacagcgaatggaaaggtgcttagcaagtccattactgctaatcatatttattttatatgccaggaccatcgccgatatgaacaaaaatcgcagacatggagtattgaggatgcgctgcattggacatttgacggtaataaactcggctttacatgggaagttgtagggcattttgaaaaggtacaaatggacaatttcggtgatgcgaatgctcttagcatggttgaaaccattataagtagttttaacgccgttttagatgcagataacaagcatcttattttttacgctccggacagttggggacagataactaataaccaattcagatatctttacaatacggataccgtcaattgtcaaatagatacgacagaactcaagactgttattcgcggctatggaaaacagaatgatgatggaacctatgcttttccttttgtgacttataaaagtccatatgttacacaatggggggagcggcatgcggatcctatccgggatgatcggtttactaaagcagagtctatgcttgcctacttaaaaacgcaattgcaagacaaaccagccgtcacgctgtccataacggtaaaacgaaaagaagaaattaataagggcgatcattggatacttatctacgagcccatgaattttgatacagacgttgaggttatcggttataagaaatatccattttcacaatacaagccgccagaagttacttttagcaacgacgcgaaggacatgaccggcatcttatccagttttaatcgagtggggaaaatagtcagttcggcaattgataagagcggcaatgtaaaaacgtcggcgatcaccaagctccctgataataaggtttctgttggaccgggaacaagcttttcacccggctacgacccgacacaactagatataccaaagtattcgctggccacgcctacgtcagatgggttaatgagcgcagcggataagcaaaaattagatttggttattgtggacagtaacggaaatgtagtagtaaacatcttacttgcaacagctaatcaagatggattaatgagcaaagaggattttgccaagctcggcaggatccttttttcgggttcgagcacaatcgatctgcaaacagttttgcaaacattgcaggaccatggcaacagaattgcagcattggaaaatggaggtggtgcttgatgcggtggccatatgcaaacattggagttgtgacgaccaggacgtttcgtaatttactaaataaaatccacggcgatattgctgccgatatgcaagaaatgaaaacgaaccttgataatgcagttgaaacggtatcagaaaaagcctttaacaaagtagttgatgccgcaaaaattgattggttgccaccagttaacacatttgatgatttggcgattacctatcctgatgcagtcgaaggcaaaactgcaatgtgccgggacagcggtaaagtataccgcaagatggcggacggagaatggcaagagatacaggatatcgatccgagtgtaattaacgaggtggatagccggcttaccgcgcagttggcggaaacggctgataagattaatgttagcaaagtagataatttacttaatttcatcgatgctgaaagtgatatggaaattgaggttcctagttattacaaaacaaaaataaatgagattgttaaatctattgataaatcggaattgaatataggttttattacagataatcataaccagtattctggttatgcaccaaagtcacttaaacattatgagtatattgctttattgagtcgtttgacccacctagatgcagttgtttctggtggcgataacgcgaatggatggtattcaaaatcgcaaatattatcagagctaaaaagtgccgcgtctgcattgtttaatcgcgttaaagccgatacagatgtatattttttgcatggtaatcacgacaatggcgcttttcaaaacggtaaaaataaacttgaagacattattacaaacgaagagttaaaggtgatataccaaacaagaaacacagtatttggcgaagtaagaaatggagatagtatttattgctataaagattatgctgataaaaagattagagtgattatgctaaattcttttgattttccaaatgatattaattccgatggaacactgacctacgataacttacattatgggtgctaccaaaatgaacaacttaattggttggcaaatgtagcattgcaaattccgttagattatcacgcgttaatttttacgcatgctcctttacctggagcgtttgataattcaacacagtataattctgatgtattacttaacattttaaaagcatttaaaaatggacaagattatacaattgatgataaatctaggctctttccagtatcaattaatacaagcttttctgaaccaggaacgctgattgcaataataaatgggcatttacatcgtgatgattctacaatttataatggaattttgtgtattagtgtagatgcatctctatgttattctggtgcaacgggtagggttgtcaatactgaaactgaagactgttgggatgtattaagtattaatccaaatttaagaacaattagagctaaacgttttggatttggttctgatagaaattggacatattgaggtggtaacatggatactactattaaatcaatattcgagagcttacgtaaactaatttatagagtggatgcccacatcggtaattctggtgatgcacatttgccagccacttttgaaagagccgggtttttaagtgcagaggataaagggcatattgacatgaagtgtcgttatgcacagacactagataatgggacagggaattgtttaactttgggtgcggggatttacatttcgaggagttttaaaaatgcacctaatggagtagatgacagcctatgcttaattgaggtaactggtgctggacaaggtttatacaaggaaatcaagtttacgtggctctcagcaggtaaacagtataacagatatatctattccgatattgacagtggttggttagatgagggctgggttaatttaactttgctaagcggtttttcagggtacgcaatcgcaaaacgtacacgctgtggagatggcgtaatcgtagacatacgatatgatgtgcaaagatctaacaatattactgctgatacagttatagcaacgctaccagcaggatacacattaacacaagaaaaaccgctatatgaaacacacttagcattcgttactaattcaacagcactaactacggtcgggtttgttatatccggcactaaagatttaaccctgtttcgaacagatcaggatagctctatcgctcgtgtattagggcatactacttttataagataacaggagtgataaaaaatgaaatacattatattagactctgatggtcattatatacaagattgttattatgagagcgaagatcaggtaaagaatgaatttgaaaactatacaactgttgaacccccacaaccgtgttacgctccaaaatttaataaagaaaaaaacgaatggacggatattaccggtgaagaatggctagcgaaacagccagtgctcggagttgaaaaatcagagatggaaattttgcaagaaaagttaggcttaatgcagcaagcaatcgatgacatgattttaggaggtggttgataatggcggcttatatggggcagcgcattatagacaaggcatacacttacgactttgttattaataagcgtgctgacttaaaagagggtatcgatgcttatttaactgagcatggccaggccaatcttattacaaatacaggtacacagcaggatcatactgtgacgtaacaaatatctatgaggataaaggaaacaccctcctacttatcgaataatccatagagaggaggtgtgtgatgtgagcaaagaggaaaaaattcctgattttgtacaaagatacagccaggagattagcgatattacttatattctcaagaatcttgagaacgggagatattacgaaaataccggggcaaaaatggacggtcctataccgcataatgtgcaaactttaaggaaactgtttgcagagcttttgataaaggtggatgggaatctttcatctgaaaccgaagagatgatggaagcattaggcggggatgacaacaaataatatgattaacagtgatgtgaaggagtccttgttatagggctcttttttaatacccaaacaaggaggcggatcaaaaatcggcaggaagtaaagacagattgggggtgtgggtccattggaggcggatcagcaggtggatatctggcgggagacactgcaaaaagacctagaagccataaagaccgagcaggtaaatatgaaaagcgacattcggcgcctgcaagacaaagaacttatgcaggatcagcagattgacagcataaaagaggatttgaaagagattaaagaggacacaaaatggttacggcatgccattacaaatgcgcttattgttgcgcttattggcggggccgtagccattttctttgctgccattcaaaattttgattaggaggattgaaaatgaaaattgacagaggtacattaatccgcacaatcgtgctagcaattgcactattgaatcaaattttagtatcgtgtgggctttataaaatcccaggcaccgcggagcagcagacggaagtattgtccacactgtttacacttattacggccgtatggtcatggtttaaaaacaattacgttacagcccgtggcaaagcacagcgcgaagcattaaagcggcaagggttatcaaaataagggcggccacatggctgctcttatttataaaaaaatttaaggagatggacaaacatggcatacagtattcatgctggacacaacttccacgtaactggcgcacatggatttataaaagaggaagttgtcgatcgtcaaatcaaggatgcgacaattaaatatttaaaagcagcaggacaaaaagtatatgatgacacagatgaatcaggtaaaacacagtctcaaaaccttgcaaatatcgtgcgaaaaatcaactcgcactctgttagtctatcggtcagcattcacctcaacgcagggggcggtacgggtatcgaggtacaccaatataacagccaaacggatgcagtcgcaaatcgcatcttaaaaggcatctgcaaagtcacagggttgcgatctcgcgggcttaaaaagtctccgggtctatacgtgctaagaaacacaaaacctcaagcaatcctaattgaggttggttttgtcgatacaaaagaggatgccgatgtcgtatctaacaaaacggatgctatcggcaaagcgattgcagaaggtattttgaatagatcgatcatggcatcaaaaaatccttcaaaatctaagacaacagcggaggaaatatatagggtgcgcaagtcggctaacgatgcaaaaagccaaaaaggtgcgtttggggacaaatccaatgctattgcttgcgctaaaaaatacggatatagcgtatacgatgaaaaaggcaataaagtatattctgcagcaccgaatacctatacagtcaaacgtggtgattcgctttggcggatagctaaagatcacaatactactgtagaaaagcttaaaaaactcaatcacatttccggtgacctaattcatccggggaaaaaaattaaattgaaataatagaaggtcccattaaagacaaatcaaaagccctcgcgtttgcgggggcaaatttgtacgactggcatccaatatgaaaaatgaaaagaggttatcctgcgtatttaatctaatttagatagtttaagtgtcacatgctcgtttttccctaatctttgtgtcccggtattgctgtcgccaggaactgtttcaaattctccattatcatttttctgtaataaatcaggggcttcaaaatcaatgttcactttttgcggtgttttatcctgattctcgaacttgataaatatgaatcctttgttaatgaccgggccgccataagtaactcccgccttattttcctcattggtcatgtggtcgatatcatccccaatttcttcagctgtatcagttatgatatcaatctttgtccccgaatagtcaatgaatttaccacttttggtgttatctcccttttcaagaaaaagaagccctttttcaccatccggatttgttgcaagctttactgcgtaattaagaatgaaagctttatccttgctctccccaaaaataatctgatacatgccgtcattagtgggcccatttaaatactccccgttaatcttatactcccctgaattttcatctacaaaggtagtgttttttttggcagcaaccaatatgtcggatgtcgttttagctactggctttttttctgtttctgcggtcttggctttagattcctctttggatgttgaatttgattgtgttgcgtttcccccgcaggctcccaagccaaatgttaataaccctgtaattccaaaaattaatgccttcttcattcttcttcctcctcgtatttttatttttaaattttcaaggtcatgaccaaaatcatgaccaaaaaatgaccaaaatcatttgaaaagtattgattgattttgaaagtggaatctaaaaacttccttatttatatggattatcaaaaatgatgaaagtaaaaaaatgtaaaatacatgttccgcacacaagtccaccaatgggaacgcgaccagtatatcgaaatgtattaagcaagaaaccccttgaagcgtaaggctttgaggggtttttgtttatcgggcatttttgcgtcgaacgcccagaaaaacaaaatgcccattaattgccccgatttttccttcgaaaatagattggaagcccagaaatcctcaagtgtcacaggcatttttgccatcaaactcgcatatgctctattaaaaaagaagcagccgaaactgcttctttttgatcagtgcaccatttgcctgtacagcccgatgacaacgccgagaatggtgacgtttttcaatatgatcggttccattgtctggttttcaggttgcagccggaagtagtctttttccttgaaaaatctttttactgtcgcttcattttcatctgtcatagcgaccacgatatctccgttgtttgccgtctgctgggagcggacaatcacataatcgccgtttaaaatcccggcatccaccatgctgtccccttcaatttccagcatgtagacggactcgtcagacgggacaagatgttccggaagcggaaaatactcttcaatattttctacagcggtaatcggtatgcctgctgttacttttccgacaacaggcacattgacaacattttgggccggtatttcttcatcatggtccaaaatttcaatcgctctcggctttgtagggtcgcgcctgatcaaccccttgctttcaagccttgcgagatggccatggacagttgaactggaagcaagtccgactgcctggccgatttcccgcacggaagggggataaccttttgtttttacttcatgcttgatgaaatcaagtatcgcctgttgccgttttgatagttttgccattctattcacctcgtcacagttttgtttggcacccgcgctgcgtatggggacgtttacgggaggaatgccattatttgctattattatatcacattgcagcagataaaacaaacgtaagttcgaaaaaatgttgacgaaaaacaggcgttcgttttataatagaactggtgattggacgaacgaatattcgcgggaggaagatggagatgtcacgattatggaaaaagtataactatgttatgattttagcagggcttacgcttgttttcggatttttcatgattggaagtctgcgggatccatccccacactatatcaaaatcagcgtcacagagggcgatacgctttggaacatcgccgggcagtatgcggaaaagggcaaaatgtcgagggaagcatttatcagctgggttgagcgtcataatgatattgacggcaacatgatcaaagccggcgaaaaaattgtcattccaatagaaaaaaatgaattcagcgatgataatagggaacttgcgatgaaatcacaacgggagacgaaaaaatgaaagttgttttatattgcagagtaagcacggaaaaagaaagccaggaaacttccttggcgaggcagcgggaagagctggagaagctttcggattcccacggttttcaagtggccggggtgatctgtgaccgggcaagcggctatgacctggacaggcccggcatccttgatcttcttgatacgattgaaaatgaaaagattgacgccgtactggtgcaggatgaaacacggatcggaagaggaaatgcaaaaattgcattgcttcattttttatataaaaaagggattaaagtatattgttatgcgcaaaacggagaattggagctttcggaatctgattcaatggtgctgaaaattgtcagcatggttgaagagtatcagcgaaagctgcataacttaaaaattaaaaggggaatggagcgtgcagtcaaaaacggctaccgtccggaaaaaaatttaaaagggaagcggaatccggacggcagggagcgaaaggaagtgccggttgaagaaattatccgcctgcgggataacggcttgacttttcaagaaattgctgcgactatgcgcggtttcggctaccaagtttcaaaagcaaccgtccaccggcgttacagggaatatatggaggaaacggggcatgataaatagtatcaaaaccgtttcacgggtgcgctttcgttgcaggcgggtccatattttagtaagatggcatcaattacggataaaaggagagaaaatatgctttcaaaagaaaaaatggcaaggattaacgaattggcgaaaaaagcgaaaaccggcgccctgacaagtgaagaagcaaaggaacagtcaaaattgcgaagcgagtatttgcaggcgttccgctcttcattcagaaaaacgattgaaaatgtccgtgtgcttgacccggctggccaggacgttaccccggaaaaaattaagcaaattcaaacaaaaagaaagctgcactaaaaaggaaaccatcctgcttttttcttacaaaatccatacaaaatggtaaaagagttgtgttatgggtttcacttgccttaatatagagttgtaacccatgaagaaaggatgttaacagatgtttgataaaacggacgaactggcagtcacaacaatccgaacattgtccattgacgccatcgaaaaagcaaaatccggtcatccggggcttccgatgggggctgcaccaatggcatacaccctctggacaagatatttgaaccataatccggaaaacccgcactggtttaaccgggaccgtttcgtattatccgcagggcatggttccatgctgctctatagcctgctccatttatccggttatgcattaagcatggatgatattaaaaatttccggcaatatggcagcaaaaccccgggtcatccggaatacgggcatacggaaggcgtggaagcaacgaccggtccgctcgggcaggggattgccatgtcagtcggaatggcgatggtagaacggcatctggcggctgtatacaataaagaaaatttccctgtcattgaccattatacatatgctttatgcggagatggcgacttaatggaaggcgtatctgccgaagctgcttcattggcgggacacttaaaattgggacgtctcattgtattgtacgattccaatgacatttcccttgacggcgacttaaataaggccttttccgaaagtgttgccgaccggtttaaagcatacggctggcagtatttgcgggttgaagacgggaatgatatggcacaggtcgcaaaagcgatcgaggaagcaaaggcggatacaagtcggccgacactcattgaagtgaaaacgatcatcggttacggttctccaaacaaatccgggaaatcggctgcccacggcgccccgctcggagaagatgaactgaaactaacgaaagaagcgtataaatggacatttgaagaagacttctatgttccggatgaagtttacgcacggttccgtgaattggttgtggaaaatggcgtgaaaaaggaacaggagtgggcgtccctgtttgaggcctatgaaaaacaatacccgcagcttgcggctgaactaaaacaggcgataaaaggcgggctgccggatggatgggacaaggacattccggtctatgaagaaggcaaaacccttgccagccgtgcggcaagcggggaagtgctaaatgccgtctccaaacatttgccgtctttgttcgggggatctgcagaccttgccggatccaacaatacgcggctgaaagaagacaaggactatatgccggatgcctatgaagggcgcaatatttggttcggtgtccgcgaatttgcgatgggcgcagccatgaacggtatggcgcttcatggtggtgtccatgtatacggcggcacgttctttgttttctcggattatttgcgtcctgccatccgcctagctgctcttatgggccttccggtaacgtacgtctttacgcatgacagtatcgctgtcggggaagacggtccgacacatgaaccggttgaacagcttccttctttaagagcgatgccgggcttgtcggtcatccgccccgcggacggcaatgaaacggcggctgcctggcgccttgctctgtcatctgaaaaccatccgacagcgcttgttttgacgcgccaagggctgccaaccttgaaagggacgtctgaaaaagcgttggaaggcgtttcaaaaggtgcctatgtcgtgtcccctgcacaaaaagaaacggctgacgttctccttcttgccagcgggtcggaagtccatctggctgtgctcgcgcaacagcaattggcggaacaaaagattgatgctgctgttgtcagcatgccgtcatgggaccgttttgaacagcaaagcaaagcatacaaagaatccgtattgccggcacaggtgaaaaaacgccttgccattgaaatggcttcaccattcggctgggaaaggtataccggggatgaaggcgatattttgtcggttaatacgtttggcgccagcggaaacggtaaaaccgttatggaaaaatacggatttaccgttgaaaatgttgtggcacgtgtaaaaaaattattgggcatgtaatcgttccgggcctgcttttgcggtattcgcgaaagcaggctcattttttatgcaggaagggtataagaaaagggggactaaaagtgcgggggctgagctgaatggcttttcccttggatgctaccgcataatcggcagcgcgttgatgtatttacgcttattttcttgtctgtacatgcaatcaaatgtttcaaattcattttttaaattttgttacaacaaacgacaacttttttgaggcccgtccattatagtgaaggtaacaaagttgcgggagtgagatcatatgcggtcctattctatctatctgataaaagaggagtttgcacaatattattacggcagggaacgaatgttttttaatctttttcaccagtatgcgcacgtttccggaagtttgaaaaatgtcctcagcagacagatccattatattacaaagccgattccgctcttgtctgtccatcatgtcttgcagccgttattttctgacaccagcaacatgacgaaaacaggcgcttgccaacttctttcaaagaaagaggggcaggtgctggaagtgaccatagaagaaagaatgctccagctgaacgtatacgggagttatgatacagaaaccgccgtttttgaaattctgaggaactttaaaggagatttgcttgcaatcgattatgaccataaacgattcggctggataaaaccggttaaagaaagaaaattcgtgtgagaagaaaacaagtattgtataattcaaatggatttagtacactgtatgtgagtgaaggaggtatattatgatttgggtgttcgttcttgtagccctaattgctcttttggcaggcgcagcaatcgggtttttcatcgcccgtaaatatatgatgaattacctgaagaaaaatccgccgattaatgaacaaatgctgagaatgatgatgatgcaaatgggtatgaagccgtctcaaaagaaaatcaatcaaatgatgaatgccatgaacaaacaaatgaaatcttaagctgggcgaccggcttttgtggtatatccatcaccattgttaagcttctcacgattctgtaaaccactttttctgccaattttctgcacagaaaaggtggtttttgatttcatgttccatttttatgctttttacgatgttttttctctttcaatcagtttatgttaaaatgaaaatgagccgggatggggagtgaaccgatggctgatgtaactgtatggctgtctttcggggcaggtttcatgagctttatatcgccttgctgcctgccgctttatcctgcttttgtttcttatataacaggcgcttctgtcagccggttaaaaagcgggggcggcatgcgggagtggaaaagtatcctgcataccgtttggtttctcgcgggattttccactgtttttattgcattggggtttggtgcttcctggatcgggagtttttttatccgttaccaggatgtcatccggcagctcggtgcagtcgcgctcattttttttgggctgcttgcagcgggcatttttcatccggggatctttatgaaggtgtaccgaatcgatataaaaaagcagccggcgggatttttgggttcttttctcgtcgggctagtgtttgctgccggctggacgccctgcaccgggccgattcttgcctcggtattggcaatggcagtggcccatccggcttctgcgtcggtctatatggctgcatatgtacttggcttttccatacctttttttgtccttgctttttttatcggacggttggggtggatgcaaaaatacagcgtaaaacttttaaaatggagcggtgttgtgatgatagtcgccggaatcctgctcttttttgactggatgcctgtcatttccggttatatgagtgcactgttcgggggattccagggattttaatccgggttgcattttaacggatcaatgaggaggagaaattcgatcgatggcaaatgtgttaattgtggatgatgcaaaatttatgaggatgactttggcgaaaatgctggaaaacggcggccataccgttgtaggcgaagcggagaacgggcagcgggcgattgaattataccgtgaagtcaggccggatgttgtgacgatggacattactatgccggagatgaccggcattgaagcggtaaaaaagatcgtgcgcgaattcccggacgcaaaaattattatttgctccgcgcttggccagcaaaaactggtcgtcgaagcaattgaatccggcgcaaaggattttatcgtcaagccttttgatgaaacgcgtgttttagaagcggttgaacgcgttttgaactgacaggcgccacaaaaaaagggaggcaggcattccggctggacatcaaccccgcttttatggttgaatattaccataggaaacatatatttatcgtatctacatttcttttgttaaaaatctgttactaaagagggttgagacatggaaggcattatcatctcgttcattgttgcgattttgatggggtctttggtcatttttgtccgtttaaaagggcagaacaagcccgtttccacaaaaaaaatattgttgccgccggtctttatgagtaccggggcattgatgtttgtcgtcccgtattttcgtgtgacacctgccgaagtattggaagcatttgtggtcggaatgttcttttccatatttttaattaaaacttcccgtttcgaagtccgtgacggaaacgtatatttaaaacgatcgaaagcttttccgtttattttgatcgggcttcttctcatccggttgctgatgaaggtggtgcttagttcttcgattcaaatcgggcagctgagcggcatgttttttctgctcgcattcggcatgattctgccgtggcgcgtcgccatgtatattcagtacaggcggctcatgcaggaactggatgaaggggtccgtgcttgaaaaaacatcattcgcttttgccgaatgatgttttttcatttattgggccgattttgttttttcctgcgcaaacaattgctcatatcggctgtcgtcgatgttcagctgcttcaatttttttcggaggaatttatggtcgcgtttcggcgtagcgagaatatagccctgaatgatattgtccagtgtcattttttttgtatttttggaaagcgccacatccccgatttttgctgcgatctttttcctggccacatcgcggaacaattccgggacagggcttaccagttcttcaagcagttccctgtactccggcgtccagaggtgccgcgttttaaggattgtctcctcctgccggtcaagtattgattttccgtcttctttcggaagccttttcaaaaatttccggaacataaaatagccgccaactgaaaagagaaaaacgagacagaggatccatattaaaataaaggcagaaaaccatccactcagcatgacgctctcctccttggcaagtactcgcttttattataagaaaagatggactgttttttcaattaaaaaaggaaaaaccctttcgccggccggcaggggacagagaaaaagggatgttttatctttatttgtccatgaaaaaaacggtgaggcactttgaatgcggtgcctcgccgtttttttgatttcttttgtgctttttcatctgcttcgggcaagcagaaagcatttttactgttttttcagcgcttcaaaagtgtcttgcagcagaacaatcgttttttcaatttcttcttttgttccttttttttcgtctgccagcctgatcgggtcgccaaagcgcacgcgtttcggctttctcgcgaggacttctttgaacgttttcggcccttcgtaaatggccgggacaagcggcacatttgcttttaaagcaatcgtcacggcaccgcgttttaaagaaacatgttcgcttttgcgtgttccggaagggaaaatgccgacgaccttcccttcttttaaaagtttcattggaattttaatcgagctcgggcccggattttcacgattgacgggaaaagcgtgcaacttcgtgaatagccattttgaccattttttagagaaaagttcctgtttcgccatataatgaatttggacaggccagatggcaatcgccaggtaaataatatccagccatgtttggtgggtacaaacgaccacaaacggagccgcagggattttctctttgttttcttttttgattttgccgccaagcagccaaaaaatgccggcaacaacataatagccaaaccggtacatgattacacccccacaagcattttatactatacaggcatgcttgttctactaatttggaaaaaaatatttaaaaacgcgaaatgaatcattggaaaaaagaagatagcagccaaaacagcgtttacggaaagattaaaataaagaaggaatatgataaagcaaggcagaatttcatacggagggaaacggattgcataaaagatgggtcgtgatatggacgatggcatttctatttattcagggaactgggccttatgcagcaggggacagggaaggctgcgggaaaaaagaaacagacgcaaagattgccggtattcttgaggccgcccctttaaaaggcgggatcgttgcgatcagcgtccgttcggctgatagcgggaaactgctctacgaacaaaatggcaatacgctgctgcgccctgcatccaatatgaaactgctgaccgcagccgccgcgcttgaaacgctcgggaaaaatacccgttttaaaacgggcgtgtaccggacaggcgcgatccaaaacggtacgctttacggtgatatatacatacaagggggaggagatcctgctttattgaaatccgatttagcggactgggcggctgaattaaagaagcagggaatccggcgtattcagggggacctggtcggggatgattcgcgctatgatgatacccggtattcacttgacttgccatggagcgatgaacaggaatattacggcgcacaaatttcggctttaactttatcgcctaaccgggattatgatgcagggacggccatttttgaagttgttccggcaaaaaaacccggcatgaaagcgcgaatcaaaatggttccggaaagcgggatggttaaactggtcaaccatgtccgaaccgtgcgagacggtgagcagcaggaggacgatatcgtcatcagccgggcacatggcgggaatacgtttacggcaagcgggacgattacagccgattccgccgcagtccggcaatggaaagcggtctgggacccggcgaaatgggtgctgtctgttttcaaaaaaacgttagaggaaaacgggatcaccgttcaaggcacaatcaaaacgggcagggtgaaggatgcagcagttccggttctcttttcgcaatcgccgcctttatcaagcatcatggtgccgtttttaaaattcagcaataataccatcgccgaaatgcttgtaaaagaaatggggaaaacggaaaaaggggaaggaagctgggaaaaagggcttgaagtcattcgcagcgttgcaggtaactttggcatggaccctgaccagatgatgctccgtgatggttcgggcatatctcacgccgatttggtccgggcaaatgatttgacggcgcttttataccggatacaggaaaaagactggtttccgtgctttttcgatgcgctgcctgttgcgggggctgaaaacaggttggaaggcggaaccctcagaaaccggtttaaggggacggctgctcgaggacaggtgtttgccaaaactgggtcgattacaggcgtcagcacactttccggctatatgcaggcaacatccggggaaaagctgattttttccattttgatcaataatgtactggatgaagaagcagtacatcaagcggaagagcaaattgtactgcaattcatcaaccaggggggagaaggatgagaaaagggaaacgattacaggcgggagatacgatcgggctggtcgcgcctgcaagcccggtctcaatcgaaaggcttcaaactgctgttgcgaaattgcggcggctcggtttccgggtaaaagtgcgagaaaatgcggagaaagtatacggtgggtatatggccggtacgccgcttgaacgggcagccgatctgcatgcgatgtttgcagacgatgacgtgcgggcaattctttgtttgcgcggcgggtacgggacaccgcaaattttaccgtatctcgacgttgaatggatccgggagaatccgaaattatttatcggttacagcgatattacagcactacacatcgttttccagcaaaaatgcggcctcgccacgatccatggcccgatggcggctgtcgaatttatcacagacgatgcgctttcggtacaatcattgctcaagctggcgtcaaccggtgttcctaccggcagttacacgggggaagcgtggggtgaaggggtcatgacagcgccgcttacaggcgggaatctgtcattaatctgcgcactgatgggaacgccgtttgaaatcgatacaagcggaaaaattctttttcttgaagaagtgcatgaagagccatatgcgatcgaccggatgctgacccagcttcagctttccggaaaactggatgacgcctccgggtttgtgctcgggcaatggacggactgtgagccggaagcatacgcggatgggtttacggcacaggatgtcctgaaaaagtttttttacgggagcggtaagccggtgcttgccggcatacagtccgggcacggtaccccgaatctggcgcttccgctcggcatcccggtcacactggatacggtaggccaacgcctgcatttttgcgaaaccattgtcgttgaataagcttgcatatcgttctcatcataaccgcatacttattgcccgtacggtatgtccggaagcaggctggcctagcaaggggtttacaatgcagacgcacatccggccgtttaaattggcgcctgttttcccgcttgcaggcggatgcacaaacgatgcgcttccaactgccatattgtaaaagcagcaatggataaaggagtgacaaatttggcagaatccaggcagtattatggcggctatccgggccattatatgccgtatgggcaccaccaccattatggaggatacggtggttacggcggttatccgtacgggcattcgtacggccactcgtacggccactcacatggttatggttacccgcacggccaccatcatcattaccattccgggcattacggccacagcggatacgggaattttccgggccacgggtacagggaagaaaaataaaacgctttaccgaaaaagatgcctgcgtgcaggcatctttttcccatttttgcagcagcatttttccaggcggatggattcggcagccatgaaaggttttcatccgaaaaaatcacggcattagtggagaaaaaaataaagaaaaaaataaagaaaaaaataatcaattcgtcttgacaccacatttataatctgctattataataaagaattatttttgttcggtatggtaaggaaggaaaaagttttaaaactgaccccctgaaatcacttgagcaaggatagtaattttgtgttcaaacacattaggaggaaacaaaatggaacaaggtaaagtaaaatggtttaattcggaaaaaggctacggatttatcgaacgtgaaggcggcagcgatgtatttgttcacttctcagcgattcagggcgaaggttttaaaactttggaagaaggccaatccgtatcttttgatattgaagaaggcaaccgcggaccacaagctgcaaacgtttcgaaattataaaaaacaggcctttatggcctgttttttttgccttgggaatcaggttcacacgtccctttgctaggaaaaaaaatatccttttaatccggccgcttcggataaaaaatagatacatattgcaatcgcgatctttcataatatatgataagagcaatgccaatatggataaaggagacaggggaattttgcaaatcagagaaatggcaacagaattactaaaaaacgccgggtgcaccgcccatttgaaaataaagaaacagttccccggcgggcgccttgttggcggcaaataccatccgcacaccgatacgattacgctgtatatagagacaatccggcggcagtgcgagctattgtttggaagctgcgaatggtttttgccttacgccacgattgtgcttgcacatgaaatcggccatgcgatggatgaaaatctgcctctattgtccgccgcctttgaagagtccgggcatttaccggaaaagcaagcactggcacttacgattgagcaaaatgcgtgggattttgccggccagctgatccccgcacatcttgagccgctttttcaaaaaatcatggatgagtcgctatctgcctaccgccaaccggtgatggcgggtgcatattaagaaatggcaaaaaaaccggaagaaggaaagtcttctttcggtttttgctttatttaacgattggcagtgttccgtgcacatagggcggtgccggttgttgtccgacacggtcatgggatgcaaaaggttcgacaaatttaaattcaccttttccatcaatgctttcgccgctcgcccatcttcccttggcactttctttgccttccgaatgattgataaagagatgggtaaattcttcaggctcctgttcaggagggaatgtgctcggcacgacaacaccttcctgttcttccagttcacgcagggcggccagccactggttctgatgcatcgtgtcccgcgcgatcaaaaacgatagtgtttttttcacgcccggatcgtccgtcatttcatataagcggacgacttgaagtcgcccctgcgattcagcgttgagattggcgcggaagtcagcgattaaattcccgcttgatacgatataactgccgctccacggaacacccgcactgttgaccggcaacgcgccgagcccgccgacaatggcgtgttgcggattcatcccgcccatgacagctgcaatggcagggtctttcgcaaccgcttcttcctgcattttgaccggtgccttatcgagcaggcgggcgattaatgtggcgagcatttccacatggccgatttcttctgtcccgatatcaagcagcatatcccggtatttttcatctgcccggcagttccatccttggagaagatactgcatcatcacagagatttccccgtattgcccgccgagcacttcctgcactttattggcgaaaaccggatccggcctttcaggttttgcttcaaactgcaactcttttttgtgtaaaaacatctgctccactcctgttccggttttgatcttcaattcctgtctaccctaggaaaaacgggttaaacattcgaaaaaaacgaacgccggtgtttaagaacggggcaaaaaggcaatataaaaagaaatctgatttacatacaagggggaacataacgatgcaaaatatcgttgcaaaaacagaagacaattattttgaaaaaaataaatcgaaagtggacattcacgtgttcgacaaggaagattctcgcccgtttgcaaacttccctttttccagccggaaagtgtatgagtttttcgattatacgctgcgtacgccgctcgaaaaaacagatgctttctatgaaattttaaaaatgccatatgcatgtgagatttggattttgccggtaaccgagaaatcttcccattttatgcgtgaaattcaagaaccgaaaaccgctgctttgttttcctttttggcgaaagtgaaagacaccattcagcgcgaccgcacctttattgttacggatcaaagccatgcagcggcagtagctgaagaaatgaaaagactcggctttacgatgacggaacccagcgcggcggaactggaaaaactcgtcatttcttttggtgattaatatggggacacgcatatgcagttaattggaatttttgccggacccggggaagcagcggaagccattttacatcatcatagagaaaatgggcgcattactgtcatcgccaacaatgctgcggccatccgtgaagtcggccgcgaagccggaaaaggtgtaaacggaatatgccttcatacggatgtggatctcatgaatgaactgaaagcactggtcaaaagaaaaacatacccggaaaaaatattggaaaaggtccttgagctcggaattccgcttgaaattgccacccggtatgtcggtgcggcggcaaacggaaaaatcgtcgtattggcacacgactaattttccttgcagacgaaaaagatcaagccctgccggatgcaggccttgatcttttttgttatgcttgaaagcgaaaagtttctatttttttatatttttaaccttgtataatcatacataatgaattataataatgcacatacataacaatagggagatgaaaatgttgaaaatagggattgtcggggcaaacggatacagcggtgcggaacttgtcagacttcttgcccgccatccccgcgcacaactggaaatgttgatatcgcaccgcacaaaaggcacgatgctgaccgcacattacccgcatttccagcaaatcatagaagccggattggaagacatggttccggatgaaatcgcaggcagggtagaactattgtttttcgcaacgccgtctggggtagccaaaaactgggtaccacggtttgttgataaaggtttaaagtgtatcgacctgtccggggatttcaggctggatggggaagcgtacaggcaatggtataaacgcgaacccgccccgcaaaaagagctggataaagctatctacggcctttcagaaatgaatgcggacaggataaaagaggctcaactgatcgccaatcccggctgcttcccgaccgcagcgcttttaggacttctcccgcctgttcaaggggggttcatcgatacttcctttattgtgattgatggtaaaaccggtgtttccggtgcgggaagaaccccttctctaggcaacttgtttactgaagtaaatgaaaataccggtgcgtacaaagtcggaagccaccagcatacaccggaaatcgagcggttcatcaaggcgtttgccggaaaagaagcgaaaatttcatttacgccccatcttattccgatgacgagggggattctttgcacgatatacgcgcctttagcaaaaaaagtcaccaccgaagatgtccgccaatattataggaaagtgtataaaggccggaaatttatccggatcaggccggctggttcttttccatctacaaaggaagtatacgcctcaaattactgtgatataggcgtccatgtggatgaacggacggggaggctcgtggtcatttctgccattgacaatcttgtaaaaggtgcaagcgggcaggcaatccaaaatatgaatctgcttttcgggctggaagaagatacagggctcgaccatgttccggtttatccataaggcaatcttaaacataccgtttatatatggaggatggcaatgaatcaattatatgaaaaagaaagtactgcattttttacgaaaacagacggaaacatctcgagcccggcaggattttttgccggtgggctccattgcggcattaaaagaaaacgtccggatcttgggtggctttactccgctgtcccggcacaagcggctgcggtctacacgacgaatcagtttcaagctgcacccatccagattacaaaagaaagcattatggaaagtgggaagctgtccggcatcattgtgaattcgggaaacgcgaactcctttacaggcaatgaaggcctccgccacgcccgcctgatgcgggaatggttcgccgctcaaatcggcgtaaacgaaagcctgatcggcgttgcctcaacaggtgtcattggcgagcttttaccggttgaaaaaattgaaaccggcattcgccgtatcgagaaagagggcacatcccatccggacctttttgaaaaagcgatacttacgacggacacctttcaaaaacgcgcctgcgtaacgcttgaaattgatgggaaaacggtcacggttgccggctgcgccaaaggatcggggatgatccatccgaacatggcaacgatgctcgcttttatcacgacagacgccaaagttgaggccgctgcattgcaaaacctgctgaaacaaacggtcgatgaaacgttcaatatgatcacggtggacggcgacacaagcacaaatgacatggtcgttgtaatggcaaacgggctggccggaaacgatacgctttcctatgcacacccggattggaagaaattcgcagaaagctttgcctatattgcccgggaacttgccaaacaaattgcaagagacggggaaggcgcgacgaaactggttgaagtctgtgtaaccggggctgaaacggaaaaagaggcacaaacggtcgcaaaaaccgttatcggctcaaatttggtaaaagctgctgtctttggcgccgatgcgaactggggaaggattatcaatgcgatcggatacagcggtgtccaagtggatgaacaaacgctttctatccgcatcggcgggattcccgtagtggaaaagggcatgccggcttcctattccgaagacgaggcacatgcctatttaaaggaaaatgataaaatctgtatcgccatcgaccttggtgccggaacttgccagggtactgcatggggatgcgacctgacctatgattatgtgaaaatcaatgctacttatcgctcataatgtttgtgcacgcattgttgcataattatacaattcaataactatttataaggggttggccaaattggcatacgttgtcatcaagtgcggcggcagcattctccatcagctgccggatgcattttttgaaaatctggtgcaaatcaaagcgcgattcgggcttgaacctgtcatcgttcacggcgggggaccggcgatctcagccatgttggaaaaaatgcagatcaaaacgcaatttaaaaacgggttgcgcgttacgaccgagccggtgttaaacgtcgttgagatggtgctttccggctccatcaacaaatggattacgcgccggctctcgcaggcgggggccaaagcggtcggcatcagcggaaccgactcacggcttttaactgccaggaagattgagacaccgaatctcgggtatgtcggggaaatcgaatctgtaaacgaacaggtgctgcttgctttattgcgacagcagtttatcccagtcatttccccggttgcgacggataaaaacggccagcgcctgaatgtcaatgctgatttggcagcagccgcggttgcccggaaaatgaacgcgcgtgtttggatggtgacggatgtccccggggtcatgatggaagggaaagtgctcccttatcttacccccggacaggttgacgggctcatccaaaaacaagtcattaccggtggcatgattccgaaagtccgggcagcagcggaatgcatccggtccggcgtaaaagaagtggtgattgtggacgggacagaagaagacagcctcctgtttttggcaggcggcggaaaaaccgggacgaaatttacagggaacggggttttgatcgatggataagatgacgcaaacggtaaaaaagcaagcacttatgcaaacgtacagccggacgccggtaaagtttgtaaaaggaaaaggcagttatgtatgggatgaaaatggagaaaaatatttggattttacttcaggcattgccgtttgcaatctcggccatgtccccgaaaaggtaaaaaccaaggtgaccggccagctggaccaaatctggcatacttccaatctgtttgaaatcgggccgcaggaagagctggctgaaaaactagcagcacaaagcgtatttgaccgggtgtttttcgcaaacagcggcgcggaagccaatgaagcggcgatcaaactggcccgccttgatgcaaaaaaacgcggaaaatcggggcccatcgtcaccttcaaggcttcgttccacggccggacactcgggacattgtcggcaacggcacaggaaaaaatccagcatggctttgaaccgcttgtgccgggattcacctatttgccgtttaacgacatcacggcactccgcgatctcgaaaagcttaagcccattgccgtcatgtttgaactgattcagggggaaggcggcgtcatccctgcggaacaggattgggtggatgcccttgtccgcacgtgcagaaagaacgattgtttaatcattgtagatgaagtgcagacgggcatgggccgtaccggtacactgtttgcctatgaacagtacggcttcgaaccggatatcatgacgcttgcaaaagggctggggtccggcattccgattggcgccatgctcgcgaaagaaaaaatcgcgcaaagctttacgcccggtacgcacggcagcacttttggcggcaacccgctatctgcgacagccggtctggcaacgcttgaaacgtttgcggaagaaaatatcatcgaacatgtccaaaaacaaagcatcgatttttggacaaaattggaagacttgaagacgcaattttcttttattaaagaaatccgcgggaaagggctgatggccggccttgaaacggaaatggaagctgtaaaaatcacccgggcggcattggctgagcatttgcttgtattaacagcaggcccgcatgttgtccgtctgttgccgccgcttgttattacggaaaaggaaacggcgctttttgcagaaaaaatgaaaactgtttttactaaggcaagccaaaacaatctttaaccggcaaagagacaagggaggacagacatcgtgacaagcggatatcttattcttgaaacgggagaaatttttgaaggcttttttgcgggaaaccccgctgaaacaacgggagaagtggtatttaacaccggcatgacggggtaccaggaaatgctcaccgacccgtcgtacaccgggcagattctggtgttttgttaccctttaatcggcaattacggcgtaaacggcgatgatcacgaaagcaaaagcatctcggcgcgcgcggttgtgaccggtgaaatatgcgcaagcccgagtttttataaagtggaaaagacggccctatcctttttggaaaagtcgggtgtcccttgccttgcaggagtggacacgcgcgcgcttgtaaaaacgatcagaaaacgcggcactgtgcgcggccttgtttcaacgtcccgcgatcaaaaagtgccatgcggcggcgatgaatttttcgtagccgaagtggccataaaacaaccggaaacgtatggagatggccctttgcacattgctttgatggatttcggctacaaaaaatccattttgcaatacttgcttgaccgcaactgcaaagtgaccgtcgtgccctttgattttacggcaaaacaaatggcggaacttgcacctgacggcattgtcatttcaaacggccctggggatcctgctaaactagccgagtggctgccggaaatcaaaaaagtaagcgccgcttatccggtgcttggcatttgcctcggccaccagctattggcactcgcttacggggcaaagacgaaaaagctgccgttcggccacaggggcggcaaccatccggttaaagatttaaagactggaaaagtgttgatgacagcccaaaaccatggctatgttgtcgatgaagcatcacttgccggatcggaactcgagctttcctttaagaatgtgaatgacggcacggttgaaggctgcatccatccggacttgccggtctattccgtccagttccacccggaagcacatccggggccgcgtgattccgaatacatttttgaccactttttacaacgagtacaacaaagagcgggagttttgtcttatgccattcaataaatcgatcaaaaaagtgcttgtgatcggctccggcccgattgttatcggccaggccgccgaatttgattatgcgggtacgcagagctgccttgccttgaaagaagaaggaattgaagtcgtgcttgtcaacagcaatccggcaacgatcatgactgatgaagaaatggccgaccggatttattttgacccgctgacggtggagtcgatagaacagattttacaaaaagagcgtccggacggcattatcgggacattgggcgggcaaaccggcctgaatctcaccgtccagctctatgaagcggggattctcgataagtatggggtacaattgctcgggacaccggtggattcgatccagaagggggaagaccgcgaaaagttccgccagttgatgcttgatatcggggaaccgatcccgccgtcaaaaattgtggaaaatatggaagacgggctggcatttgcgaaaaaaatcggctaccccgtcattatccgccccgcttatacgcttggcggctccggcgggggatttgcagccaatgatgaagaacttcgggaagtgctccagcgcggccttgacctgagcccgatccaccaggtgctgcttgaaaaaagcatcaaaggctggaaagaaattgaatacgaagtcgtgcgcgatgcaaacgacacgtgcatcattgtctgcaatatggaaaatatcgatccggtcggagtgcatacgggcgactcgattgtggtcgcgccatcgcagactttatcggatgtgcagtaccagctgctccgggacgcttctttaaaagtgattcgcgcgctcggggtgatcggcgggtgcaacatccaatttgcgctcgatccccactccgaccagtacaatattattgaagtcaatccgcgcgtcagccggtcatccgccttggcttcgaaagcaaccggttacccgatcgcccgcattgccacgaaatgcgcaatcggctatcatctggatgaaattttaaacccggtaaccggcaacacgtttgcttccttcgaaccggcccttgattatgttgtcgtgaaaattccgcgctttccgttcgacaaatttacggaagcggaccggaaacttggcacgcaaatgaaggcgaccggcgaagcaatggcgatcgaccgcacatttgaaggagcgcttaacaaaggaatccgttcgcttgaactcgggctttcaggtctgttctatccggcgcttgctgaaaaacagccggatgatttggtcccacttttaacggaagcgaccgatatccgcctgtttgcggtggcggaagcgatgcgtaaaggcatggcgctggatgacattgaaaaatacacggaaatcgaccgctggtttcttgaaaaaataaaaaatatcgtggatatggaagaaacatgcaagcaatatacgatcgatacgatgccggctgctttgctgcgcgcagccaaaaaaatgaacatcagtgatgagtgtctttcggcattatgcggatgcagcgaaaaagcggtgcgcgaaaaaagaaaacagctcgggcttatgccggtttataaacttgtggacacctgtgccgccgagtttgaggcgcaaacgccgtactactattccacctggggcggccgggatgaagtggaagtatcaaaccgcccgaaagtgctgatcatcggttccggaccgatccgcattgggcagggaattgaatttgattactgctcggtccatgccgttatggcgctcaaacaacttggctatgaaacgattgttgtaaacaacaatccggaaacggtcagcaccgatttttcaatggcggataaattgtattttgacccgctgcgcccggaagatttgctgcatattattgaaaaagagcaggtggcaggcgtcttcacgcaattcggcggccagaccgcgatcaatgtcgcatcgagccttgaagctgaaggcgtgaaactgtttggaacgaacgtggaacaaatcgaccagcttgaggatcgcaaccttttttacaagctgctggatgagcttggcattccgcatattaaagggcataccgcctatgatgcagaagaactgaaacggggggcaaaagacctgtcgtttccggtgcttgtccgcccgtcctatgttattggcggacagtcaatgttcattttttaccacgaagacgaactcaacgcttatgcggatgcgttgaagtacgcaagcgaaaaaagctggccgcttatgattgaccagtatttgccgggtacggaatgcgaactcgactgcatttgtgacggggagaaggtgctcatcccgggcatttttgaacatattgaaaaagcgggcgtccactccggcgacagcatggccgtttatccgccccagcatttaagcccgtctgtgcaggaaacgcttatccggtatgccgaaaaaatctgtttaaagggcaaaatcaaaggcattgccaatatccagtttttaatttatgaagggaccgtttatgtgctggaagtgaatccgcgtgcttcaagaaccgtcccaattttaagcaaagtcaccggcattccgatgattgatctcgccattgccatacaactcggaaaaccgcttgcagaaaaagggcttcctgcaccgccggaacttgtcgccgtgaaggcaccggtattttcctatataaaactgaaagatgtcgaccctgttttagggcctgaaatgaaatcaacaggcgaagtgctcggccttgcccggacattcggggaagcactcgaaaaaacgcttctgtccgtccaagatccggtgtttgagccgccgcttgaagaacaatttgtattttgctcggtgacggaccgcgaaaaagcagccgcgctcccggtattgaaaacattggcggacagaggctaccggattgccgcaacggaacatacggcccggttcctggcgaaaaacggcgtggcggcggaaacagtaggccttgaggatgcctccgcctttttcgaacagcaacccgtgaccgctgcggtggtcatcccgacaaaagggcgggaccaaagaaggggcggcagcaagctgcgtgaagcagcgatgcgtttccatattccgctgtttacctgtctggatacattggaagccattacccgctatgccacagggacaacgccaaaagtggccccgcttcacgattttaaccgtataaaagcagaagtttagcagaaaggaagatacagatggcgacattggcccgtacgaaaaagaaagattttttaacaatcggcgcgctgcaggaagaggagctgaacgatctgctccaggaagcggccgctttaaaaaaagcgcataaagaagggaaggagaccccgtacttaaaagggaaagtgctcggtatgatttttgaaaaatcatccacgcgcacccgggtttcatttgaagccggcatgctccagctcggcggccacgctcttttcctcagttcaagggatattcagctcgggcgcggtgagacgatccatgacacggcaaaagtgttgtcgcgttatgtcgactgcctgatgatccgcacattcgcgcacgaaaccatcgaatcttttgcgcgccacgcagatgtccctgtgatcaacgggctgaccgatctgcaccatccgacccaggttttggccgatttgctgaccattcaggaatataaaggacaactggccgggctcaaaatctgctacctcggggacggcaataacaatatgtgccactcattgctcgagggggcggcaaaggcgggtatgcatatgtccgtcgctgccccggaaggctatttgccgaatgccggcattcttgccggggctcaaaaagaagcggccaaaaaaggggtctgtattgaaatgggccaaaacccggaagaaatgatccggaatgccgatgtggtcatcaccgatgtgtgggcgagcatggggcaggaagacgaaacgaagaaacggctcgaagatttacaagattatcaggtaaatgaatcattatgcaaactggcaaaaaaagattttcttttcctccattgcctgcccgcccaccgcggcgaagaagtcacggaggcggtcattgacggcccgcattccgcggtttttgacgaggcggagaaccggctccatgcccataaagccattttaaaaaaactactggaaaatgttgaatgaatccgatataatgggtgtataaaaattcaacttcaatattaattatacaaagaggcagggagagagaaatggcaaaggaaaaaattgtattggcctactcaggcggtttggatacatccgtatcgattaaatggattcaggaaaaatacggctatgatgttattgcgcttggcattgacgtcggcgaaggcaaagatttaaatgcaatccgccagaaagcgctgaatgtcggtgcaatcaaagctgtgatcatagacgggaaagaaatgcttgcaaaagattatatattgccggcattaaaggcaaatgcgctctatgaaggaaaatatccgctgtcttctgcgatcagccgcccgcttatttcaaagcttttggtagatgtcgcggaacaggaaggcgccgttgccgtggcgcacggctgtaccggaaaagggaacgaccaggtccgttttgaagtgtccgttcaggcgctgaacccgaacctgaaagtcgttgcgcctgtccgtgaatggggcatgacccgcgatgaagaaattgcatatgcggagaaaaacaatattccgattccggtagacttagataatccgttttcgattgatgccaatatatggggaagagcgtgcgaagccggcgtccttgaaaatccttggaacgaagcgccggaagcagcattcgactggactgcgccgatcgaaatgacgccggatgagccagaatatattgaaattacgtttgaaaaaggcgtcccggttgccttaaacggcaaagcgatgggcctcgtccaaatgatcgaagagctgaacctgacagccggcaaacatggcatcggcagaatcgaccatattgaaaaccgccttgtcgggatcaaatcgcgcgaagtatacgaaaaccctgctgcagtcgtgctgatcaatgcccataaagaactggaatttttaacgctgccacgtgaagtgacacaatttaaaacaacggtggaacagcagttgaccaaaatcatttatgaagggctctggtattcgccgttaaaggccgcgctcgatgcgtttgtcgaggaaacacagaaaacggtcaccggcacggtccgcgtgaaactgtttaaaggcacccacacggtagtggcaagaaaatccccatacagcctgtataatgaagaactggcgacctatttgaaaggcgattcgtttgaccataatgctgcagtcggcttcatcaaactgtgggggctgccgacaaaagtatttgccgaaatccaggaaaacgggaaagtgttaaatcaataagccatttggccgttgtttctgatgttaaatcataagcacggcaaatttcaaggttggaaccggcccgttcaggtatttttcacctgtttaccgggccgggagaaaacggtaaaatatccggaaggctgtggcggtttgccgtgcagccttcattttttaattctattgcagcaggaggaaatgacattgtcaaagctttggggcggacgttttacaaaggaaacgaatcagcttgttgaaacctatacagcttcgatcggatatgaccaaaggcttgcttttgaagatattgaagggagccttgcccatgtccaaatgcttggcgaatgcggcattttgcctgagaacgatgtggaacagatcaaagcagggcttcggaaaattgccgaaaaaattaaaaacggggaagcagcatttacagttgagaatgaagatatccatatgaatatcgaaaaaatgctgatggatgaaatcggccctgccggcgggaagctgcatacagggcggagccggaatgaccaggttgcgaccgatatgcacctgtatgtccggaaaacgacaaaagaaatgatccgcctgattgcgctcgtccaggaagccatcgtgacgaaagcaaaagaaaacaaagaaacgatgatgcccggttacacccatctgcaacgggcgcagccggtgttgtttgcccaccatcttctcgcttatttttggatgctggaacgtgataaagagagattttcagacagcttaaagcggacggactggctgccgctcggtgccggggcgcttgccgggacgacttttccgattgacagggaacggacgcgcgaactgctcggattttcccgcatttatccgaacagcctggatgctgtcagcgaccgcgactttgtgcttgaatttttggcaaatgccgctatattgatgacgcatatttcccgtttgtcggaagaactggtgctgtggtcgagccaggaattccagtttatcgagctggatgattctttttgcacggggtcaagcattatgccacaaaagaaaaatcccgatgtccccgaacttttgcgcgggaaaacgggaagggtgttcgggaacctcatcgggctgttgaccgtcctgaaagggttgccgcttgcctataataaagacatgcaggaagataaagaaggcatttttgatacggctgatacgcttcaaggggcgcttaagctgcttgcgccgatgattgaaacgatgaaagtgaaccgggagaagatgttccgggctgtctcgaacgattacgcgaatgcaaccgatattgccgattatttggcaaaaaaagggctgccgttccgtgaggcgcatgcggtgatcgggcagattgtcctttatggcattcagcacggcaagtatttgcttgacctgacactggatgaataccagtcgttcagcccgctttttgaggccgatatttttgaagtgctgaaaccggaacatgttgtaaaaatgcggaacagcgccgggggaacaggacatgcacaagtggcggcacagcttcagatggcggaaaaacaactccgcaaaccggattgaacaagcggatgcaaacgtggctacggaatcaaaagcataagaaacgggcttcttacgcaatcgtcaggcttttaatcaggccggatccttcgcttccaactataactgtatgataacagctcccaggatgccggaaagtgtggtacaataaatcattataaaccttttaatcttatgctaatgcatcctggaacaggcacacaaagccctaggaccgggaaattgggaggaaaagcttttggttgacactgcaagacgcatgaaccagttaccgacgttgatattcaatgagcttttggcgtacaaaaagaaaaaaatagaagaaggcaaccggatgattgacttaagcatcgggagtccggatcaggcaccgcctgcttttgtaatggaagaaatggcccgaaatgcagctgacccacgccaatacgggtatacaatttccgggatcggacctttctacgaggcggcggcccggtattacgaacagttcggagtgaaactggatcctgaacacgaaatcattcagcttgcgggttcccaggatggcattatccatcttccactcgtcttttgtaaccccggcgatatcattctcgttccggatcccggttatacagcctatgaatcaggggtaaaactggcggaagccgtaccttatccgatgccacttctggaagagaacggatttatgccggatttgtcaaaaatcccggaagagatcgcaaaaaaagcgaaaatgatgatgctgaattttccgggcaacccaatcccggtgcttgctgagaaaaagttttttgaagaagccgtccggtttgcaaaacaatatgatctcgtcgtcgtccacgattttgcctattgtgaactcgtctttaacgggaaaaagccgatcagtttcctgtctgttgacggggcaaaagatgtgggggttgaatttaattccttatcgaaaagctttaacctggcgggggcacggatcggttttctggcagggaaccgggaagtgatccggctgtttgcccaaatgaaatcgcatatggattacggcatttttgaaccggtccaaagggcggctgccgctgctttggcaaacggcaaggaattcgcgcgccacaatgctgcactgtatgagaaaagaagggatttgtttgtttccggattatcgcggatcggctgggaaatccgcccgtctgatgctacgatgtttttgtgggccaaaatcccggaaggcaaaaagtccctcgcttttacatatgaactgatggacaaagccggtgttgtggttacgcctggcaacgcctttggtccccacggcgaaggatatgtcagaatcgcgcttgtacaggatgaagaaaggcttatggaagctgtccgccgcattgaaaaaagcggcgtgcatttgccgcaaaaagcgggactcctttaaggggcccgctttttgcatgttggggcggccaagccggctgtcaatgcatattatgtgaataatttcacataaatatgtgaaagtttcccttgttccctgaaaataagatagacgctcacaatgaaatgcggtatgataggaatatagaatgataatcattatcaatgaacagacgctatttctctatctctgggaggggcataccatggtcttgaccgaactgaaacccggaagcaaagggattattacagatttatcaagcattgatcaaagtattcaaaggcgccttcttgatttgggtgtgcttgaaggccgggaagtttgttataaatgcggattgcctttcggcgggccttgcatgcttgaagtcagcgggcagtgcatcggcatccgcaaaaaagaagcaatgcggatccaagtggagtgtttataatgcaggtcgctttatttggaaaccccaatacgggaaaaacatcactctttaatgagcttaccggatcatatgaatatgttggaaactggacaggtgtcaccgttgaaaaaaaggtgggccagctgaaggaaaatgccggggtgctgattgatttgcccggtatttatgccttgaacccgctttctaaagatgaagcggtggcatcgagattcttaattgaggaagacttcacatccgttttgaatatcgtcgacgcttcccagcttgcacggaacctgcatttgaccatccaattgatggagtacggaaagccggttttgatcgggctgaatatgatagatgttgcaaaatcgcgcggcatgaaagtgaacgatcgttcacttgcagaagccctcggcattccagtcgtgccgattattgcaaggacaggaaaaggatgcaaggccatatcggagcagatgcaagaaaaggcggttgtgcccgatttccgtattgattacggcgatgaattggagcatgcggcgacctatctcatggaccggctgccggatttccggtcattgaacaaacgatggctggcgctccagtttttggaaggcaatgaagtgattcgccaaattccggcgtttatgaatgtaaagccggaactcgaagatttttgcgcgggtgtggagcgcaggctccgtgccgccaacccgcatacttccattaagcaggaaatgtttaaaaagcggcagcaatttattgacaggctaatggaaaccgctgttgaaaaaacggcggcagaaaagaaaacgctgacggagaaaatagatgccgtcgtcacgaataaataccttggcgtgccgatctttcttgtgatgatgtatttggtattttgcattacattcaactggctcggcacccctttatcggattggcttgacaagtttttttcaggcccgctgaccgcctggattgaagcagggttgaaagaagcgggggcaacaccgtttatccgtgatcttgtgttaaacgggattgtggccggagttggcggcgttctcgtttttgtgccgcaaatttttgttttgtttttctttatctcggtgattgaagattccggatatatggcacgggtagcgatggtcatggacagggtgatggaatcagtcggcttgaacggaaaagcgtttattccgcttattatcggcttcggctgcaatgtgcccggcgtcatggcagcaaggacgattgaacagccgaaagagcggctgttaacgacgcttttgaccccattgatgtcctgttctgcgcggctttcggtctacagtttgtttgtcgcggcttttttccgccaccatcaggcactcattgtcctgtcgctgtatgtgctcggcattgtcgttgcgcttttgcttgccaaagtattttcaatggtggtaaaaacggaaggttctgtttttgtcattgaactgccgccgtaccgcgtgccgaatgcgcggagtttgtacagaagcacatgggataaagggaaaggtttcgtccggaaagcagggactttgattttcggtggcacggtagccatttggctcatttcgaatgcggggccgggcggattcaatgtgcctgtcgataaaagttttatggcgatcctatgcggatggattgcgcctgtcttcaagccgctcggttttggaacatggcaggccgcggctgcccttctgaccggttttatggcaaaagaagtggtcgtttcgacgatgaacgtcctctattttgttccagacggcgcatctctggcaggtgtgatttcccatgcttttacaccgctttcggcctatagtttcatggtattcattcttttatacattccatgcctttcgaccgtggccattatccataaagaaaccggttcggggaaagtgacgcttttttcgatcgcttatgcacttgtgattgcttacttgatcgcttttctgatttacaatattgggcggttcatcgctttttaaaacgggggaatgttccgatgttatttagtattttgctcggtgttgtgatttttgcttatgcggcatttacgctgatccgttttatcaaaaaaagcagggaagggcagtgcgcttcctgtgcattgaaaaaccactgcaatacagcaagctgttgtgcgccggacgctccatctcgggccaaaacggcaaaaagctgaaaataccgggccgccctttaaaaggtgtgcccggtttatgataggcagggggttcgcattggcggaaaccgtgtccggcgttccgtctgtttagatttttttgctgcggtatggtaagattaacaatgtccaaacaggtataatggcagccggttccggggccgtcccgtgccgggtaaatagaatttcaggaaaaaggcagatgagggttcaatctatgagcaaatataatgatgattatatgattacaatggatgatatcgtcagggaaggcgatccgattttaagaaaagtgctggatgaagtgaacatgccgccaactgaagaagacaaagcggaactgcgctgcatgctccagtttttaaaaaacagccaggatccggagattgccggcaaatgcaatttgcgtgcaggcgttggattgtccgcaaatcagatcggccttaataaaaggatgtttgccgtttatattgcggatgaagacggtgaaaaggcgtacacggtttttaatccaaaactggtcagccattcgatatcgatgatctaccttccgcaaggggaaggctgcctgtcggttgaccggaaagtggatggttttgtgccgcgttatgaacggattaaagtaaaggcatacgatttggacgggaatgaagtgctcattaaattaaagggctatcccgcgattgtttttcagcatgagatggaccacttgaacgggattatgttctatgaccatattaacaaggacaatccgttcgcccttcctgcaaacacggatatccggagcgtgtatgaataaacagcttgcgcaaacggcagcctgcccggctgccgtttgatgcattattctcttgtgcggaaataagcattcagctggccgcggatgacttgttcgcgcatcgtgcgttcattgtattttttctctttcatatattctttgcggatttccgcagtctggatgccttcttcacgtttattggcgatgtccatcaggcgttcaacatcggtaaatgaatatttccggatccctctgtttgtccgttccgggaaaatcaatttcctttcttcatagtagcggattcttctttcacttaagccggttaattcacataccgttccgatcgagatgactttcttttccaagtatgattcattcgttgccaccggtgcatcctccctttgtaaggtgtttttattaatatataccaaaaaagccgtttagaccatctttgtgtaagaaaacctgacaaaaatatacgtatttttcatcggcacgtgagattacataacagcagtcctttgatgttcattttggattgctcttacgcggagttgagttctttccaatttatccatataataattcaagactggtttctctgcaggaatggcggcttcccgtggccggcttaaaagcgggacagacagtttcccgtgcgcttccccggccggcaggggttaaagtgcatacaggaaagaacggaaagacggtgaatgctttcgccataaccgaaaggggagtagcacagatgaaatcatccaggctcatttttgcagcaatcgtattgatcgtcatgttgctcgccttaaatgagtatctgacccataaagaatcggcccaaaaatccgcgcaaaataacgctgctgccaaaaaactgctcgatgtgccgattatcaggcaaatggatgcgccccgcctttataacggctgtgaagtgacaagcctcgcgatgctgcttgtcgataacggttttcatgtgaccaagaatcaattggcggaagaaatcaagtatgtgccgtttacctataaaaacgggcagcacggcaatccgaacgcaggttttgtcgggaacatggaggatggtcccgggtatggcgtgtaccacggccctgtttttgaactggccaaaaaatatgccggcaaaagagcggcggatttaacgggacagcctttttcaaaaatcctggaaaatgttgaggaagggcatgctgtctgggtgattacgacagcccggtttcagccggtttctgatttcaaaacatgggacacgccccagggaagtattaacatcacatacagcgaacacagtgttgtcattacagggtacgatccaggccatatttatgtgaatgacccgtatggaacaaaaaataagcagcttggccgtgaagcatttgagaaagcgtggaagcagatgggcagccaggccattgtgatccggtgaacaaaaagcctgacggaaaacgagcttcaaagttgttggattgcccgaaaaagcgcaaaaagcggccgcccgtgaatgtatgcttgtataaggcccggcatgtccggttatattatccaaaaatggcccgtgtgtgtgcgtgttgcgtttaaaccttgaaaggcagagcgatttttttattttcatttcatggctgtttgcgctttcctttataattctttaagactgttataaaatcaaagtaaaggcaggtgcagaggtatggacgggaaaaagatggccggggagaaagcagcggaactcgtagaagatggaatgattgtcgggcttgggaccggctcaactgtttattacacgataaaaaaattaggggaacgggtgcaaagcggcctgcacatcaccggtgtgcccacctcgcgtgcgacagaaaaacttgcgcgcgaatgcggcattccgatagcagacttgaacgacacggcacaaatggatgtgaccattgacggggccgatgaagtggacccttccttaaatggcattaaaggcggcggcggggcgttgttgtttgaaaagctggtggcaaaggcatcaaaaagaaatatctgggtggtggattcccggaaaatggttcaacaacttggcgcttttccgctgccggtggaagtggtcccgttcggatacaagcatttgatgaaaacgtttgagcgggaaggattaaaccctgtcctccggatgaaagaaggccggccgtatgtaacagacggcggccactatatcgtggatataaagctcaaatcgcctgatatcggcgcgtttggagcctggcttgatggttacacaggtgttgttgaacacgggctttttctcggcatttgcgatcttgttgtcatcggggacggcagcaaggtatataccaagaaccgggcggaggcaaagaatattattttgtgaaaaacatccgtatgggagaccatacagaaattttaatttcggaggaagattgatgtatcgtttattaacccataatgacctggacgggcttggctgtgggattcttgccaggcttgcattcggaaaagacattgaaatccagtataattctgtgtccggtttaaatccccaggttgaagcttttttgaaaaaggaacataaagaagacatactgtggattaccgatttatcggtcaacgaaaaaaatgcggagctccttgatgcctatgccgcacagggcggaaaagtgaaactgattgaccaccataaaagcgcgcttcacttaaatgagcatgaatgggcttctgtccaggtggaggaagacggcaaacaggcaagcgccacttctttgttttatcggtatctgcaagcggaaggaaaaatcaacccgacaggtgctgttgacgcgtttgtcgaacttgtccggcaaatggatacatgggaatgggaacgcaacgggaatatgcaggccaaaaaattaaatgatcttttctatctgtatccgatcgaagagtttgaagagattttgctacataaacttagcggcagtgaaacgttttcatttgatgatttggaagaaaaaatacttgatctggaagagaaaaaaatcgaaagatatataaatggaaaaaagcgggaagtctaccaggctgtgattgacggttattatgcaggcgttattcatgccgagtcgcatcattccgaattggggaatgccgttgcaaaagaatacccgcatctcgattatatcgccatttgcatggtcggaaagaaacggatcagtttcaggacgattcatgaccatattgacgtatcggaaattgccaaaaaatacgacgggggcgggcacaaaaaagcatcgggggccgtgctgacggaagaggcgttccggcagtttgtcgtcgaaacgtttaaaacagaaccgctgaaacgcgattttgcccataaccagtccaatatcaaagggcaggaagcgggatgtttataccaaaaccgcagcggggaaccaatctttatttataaagaccctcaaaaaggctgggcgatcgaagcaagaggcttaaagcagtctccttctttttctgcctttgaagaagcggaaaaatttgtaaagcgccagttccaagcatggcttacccacgatgaggcgtatttggaatatatggacaaaaagaaaaaaagaagcgaaagtggtttgtaaagctgcccggtgatgccgggctttttttcgtgcaggtatagagccggttgcggccaatttgcacgaaaaaaaagcgcggcctgcaacttaggtttgccggggaaaaagaggcttaaaaaaggcgcatccgcgtttggatgcgcctttttccttaatatacaagtgagaataacccgttaatatgggccaggtaacgaatattgcttgcttctttcatagcggaagcagggaagccttttaattgcgtttggttttccccgataaatgcaatggcatcttttctgccgaggcttgcaagcgtaccggaattgatcgggtggaacgtctgcattttcccgccttttaaataagcagaaagattatagccaatcaattctcccatttgccacgacatttgtgctgttggcggataagggcgtgcgccttctgacgggaagacaaccgcgctgtcgcctgcaacaaacacatccggatgggaagtggattgcaaataggcgtttacggttgcacgcccgcggtttacttcaatcccggaatttgcaacgacacggtttccttgcacgccgcccgtccagacaagcgtttttgtttcgattttctggccgtcttttaattccacgacattatcctggaatttcgtaacagggatgcctgtcaaaaattgcacaccacgcgcttccaggctcttcgttgcccgctcaattagatttggcgcgaagttcggcaaaatggaaggcgccgcttcgacacaaataagcgagatttcagaagggtcgatcgcaaattttttcgaccatgccggcaccttgtccgccagctcgccaaccagttcaatcccggtcaggccgccaccgccgacaacaaatgtggcatccgctttgtttttcgttttgacatactgcgcaaggcaggactcgatatgggcatgaatgcgtttcgcatcgtccactgattttaacagaaagctgttttcttcaaggcccggaatgccgaagaaagctgtttcgctgccgagtgcgacaacgagcacatcgtaattcagcttaaagccgcttccgagcgatacttctttcgaatcaggcgagatttttgtgacttcatccacctgaacgtcgacatctttacctttaaacagttttctgagcggaagcgacacccgtttttcagaaacgccgcccgccgccagacggtgcaattccgtaataatttgatggtccggcacacggtttacgaccgtgatcgctgcatcgtcttttgacaaatattcacgcgctgataacgcagataacaggccgccataaccggcccctaaaatgacaatttttttactcatatggatcccccgttttcattagttctcattcaccttactgctgtttgctgcgttcttccgcgactgcaagataagactgcaggaaacggaacagcttctgggcttgcggatctttcagcaacctcaacaggccgaacaatccgattgtgtctgtggacgtctcggcacggtcttttgcttcaatcgcagtttgggcaagcccctttgctttttcggcaacgggatccagaaagcctagaaatccgcctttaaaatcattgaccagcactttatctgtcataatggattgcgcaaaatcataggctttgtttaacatggtgaccagttcggccattttcggcaggctttcaaccaacaccgtcaaagattgctggatttccggatccaataattgatccagcaaatctttctgtacgactgccgtttccggggttacttccggtttttcttcaggattgcctttttgagctgaagtttctgccatcttctatttctccttttctgatggaattcccacacatatgtagatgcaaaaaaatatacgggttccctgattcccccctcctaattgtgaatttcctcccataattacgtaccaagattcacaaagaaaggtgatgaaacctcatacatgactagtatatcaaattttcaccgtatagaaagtaatttgctttccattttcgggggaaatccgcatgtaagcttattttctgtcccggctgcctgggttatgcatagcaaaatattttgcttgcatttctgcgactgctgttgtaagataattaaaaatactgaacgtgaacgaaggaatagtaggcggatcacccttgcataagagagcggcacccacaggctgaaaggtgcagcagcaggcggcctgccgaacctgccttccgagtcccggaaaaccgggcgcaaagttttgcgttatcaaaaaagagcggggcgcaaatgtcgcccaaaaaaggtggtaccgcgaaaagcaaggccttttcgtcctttttacagggacggaaaggcctttttgtttcaccttttttagaaggagagaaaagccatggagaaaaacagagtcgtcgtaaaaatcggaagcagttctttaacaaatgacgccggtgaaatcgatgaacagaagtttgccgatcatatcggcgcccttgtcgcattgcacaaagccgggcatgaggtggtcgtcgtttcatccggcgccgtcgcgtgcgggttccggctgctcggttacccggcgcggcccgtcacgttaaaagggaagcaggctgctgctgctatcggccagagtgtgctcatccagcgttacagggaagcgctcggtgcttacggcttaataccggcgcaaattttgttgacccggaaagatttttccacaaaagaccggtaccataacgcttattcaacgataacagagcttttgcgccgcggcgtcatcccggttatcaatgagaatgattccgtgtcggtctcagaactgactttcggcgataatgatatgctgtcagcgcttgtcagcgggcttgtccacgccggatgtctcatcattttaacggatgtaaatgggctgtacagcacgaatccaaaatacgaccgttgtgcgcagcgcattgattttatcgatcatattacgcccgagatgatgaaaatggctggaggcgccgggtcgaaagcaggaacaggcggcatgttgtcaaagttaaaagccgcaaatacagcggtctccctcggcgtccgggtgtttattggaaaaggaaaagggtgcgataaactcgtcaggatactcgaaggaaaaggggacggcacgtatatcggagccgcccgcccggctgtaaagagccggaaacaatggatcgcgctgttttcggaaagtgccggaaaaatatacattgaccgcggcgcggaacaggctttgctgcaaaaagggagtagcctgcttccggcaggcattaaaaaaatttccggcacattccaaaaaggcgatgtcgtggacgtctacggcgcaaaagggctgcttggaaaaggggaagtgctttacggtgcagaagagctgttgcgcgtgcttatgaggcctagcgggcgggcagcagaagaagtcattcaccgcgatcattgggtgcctttaaacagaaaggggctgggttaaatgtctgaagccgcagaaaaaggaaaaaaagcgaagaatatcagcatggtactcgccaaaaaaacaacggaagaaaaaaacaaagcgcttttggcgattgcccgtgttttgcttgaggaccgggaaacgatcattttcgaaaacaaaaaagacctcaggcgggggagccgggcgggccttccggaaaatatactcgacaggatgatgctgaacgagaagcggatccatgatatgtcagaagcggtccggctgcttgtgaaattaagagatccggtcggggaaacggtcgaggaaatcaagaaagaaaacggattgctcatcctcaaaaagaaagtgccggtcggtgtcatcggcatgatttacgaagcgcgcccgaatgttacggtcgatgctgccacgcttgcgatcaaaacgggcaatgcggtcattttaaggggaagctcgtcttccatctgctcaaatcaggcgctcgtctcttccattcaccgcgcattggcggagacaggctttcctgaagatgccgtccagctcatcgaagatacaggcagggaggcggcaacagaaatgttccaccttcgtgattatcttgatgtcttgatcccgagaggcgggaaaaagctgattgatactgttgtccgcgaagcttctgtaccggtgattgaaaccggggcgggcaattgccatttatatattgacgaaacagcacagccggaaatggccgtccggatcgcagtcaatgcaaaaacacagcgcccatccgtctgcaatgctatcgaaacgcttttaatccatgcgcattggctcgcccagcacggtgaaaagctgcttagcgcactggcggaaaaaggggtggagatttacggagacgagccggtgcgaaaaatttttccggctgcaaaagaggcggcggaagaggactggtattgcgaatatctcgcgcttaaaatcagcgtcaaaacggtggaagatacagatgaagcgatccggcacatcaaccgttacggcacaaaacattcagaggcgattgtaacagaagacggggcccgagcggaacatttcatgttcatggtggatgccgcctgtgtttaccataatgcgtccacccgctttacagacggttttgagttcggatacggggcggaaatcggcatcagcacccagaaactgcatgcccgcggtccgatggggctggatgccttaacgtccacaaaatattggatttacgggagcggccaagtcagagaatgaatgcaaaacggcgcggccagatagccgcgccgttttattcatatgctccgggcaatcgtttggttaaaaaaacattccacataatcctgccacaatcccgaccacaacacaggaggctgcaacaaacagaagggtttgttttgaaaacgaccggccaaccatgatcaaggaaggaaggctgatggccggaagcgtcacaagcagtgcgctggccgggcctgtcccgagcccgaaagccatcatcgtctggacaatcggaatttcagccgctgtcggaatgacaaacagcatgccggcaagagcaagcaggatcaccgccgtaatgctgtttccggcatgctggccgaatgccggaaacaaccagaaacgggccgcacttaacacaacaaccgaaagcaaataagccggaacaagatacaggatcatatttccggcggcctttccccatcttaagaaaaaggacccgttgttttctccggcatctggctcgaactggcggatgttcaccggttgttcgtttttcacaagacggcccgccagccagctgaccccgaacgtcatgataagccctgcgacgatgcggagaagggtaaatttccatgataatacaaaagccatgaaaatcagcgttgccggattcagcatcgggttaccaatccaaaaggcgagtgccgcaggtgtggacacttgttttttgcgcagcccgactgcaatcggtgctgcgcagcatgtgcacatcatgccgggaatggcgctcgctccggcaatgaccgtacttccaaatgacgttttgccgagcactttaagcagccatgcagaaggcaggagcacttgcacgagcgaaccgagcaaaatgccgagcacggccgctttccaaacagcctgaaaatacgcgatcacatattggaaggtgccatcccatgaaaatgatgccgatttgcccggatccccgagaatcgatgtcccgatggaatgcgtatgggcggcaagcaaagacttctcatagtacggccaccattttacataaaaaaggccgaacgcggcaatgacgagaaacaaaacggcaagccatgccgcctttttctcggattgctgttcaggttttgccgtatgattcacaacagccaaagcaacaacatctccatttctatgacagtaaaatttataccaattgttaatgataacataataaggtgaaaaaataaatggcgggtgatgccaatggctgtctcttttttggcatggggctgctgcgcttttttatgctctttcgtgaaaaatttcacaaaaacttctgccgaaaaaaacccccggttaaaaccgggggtgggttcaatcattttttgcccgggttaaaatgtcgatcagcttgtctttattcggataatcggaagcttcaaataacccgatcgtcttttgcacatcgtaggaaacacggacattggaaacctggtaatcgtgatcgccaatttccaccatcgcataagaggctttggcgatcccgtcaaacggcagaccgacactgccgagattgacaaacgttttgccatcaaacgtgcggataaacggcaggtggatgtgcgcatataaataaatatccgcgtcttcctgcattaacttctctttcaacttgctgttttcactatccggcggcacattttcaaacaaactgtacggggtggcgtgaaatccgtgaattttaatgccaccgtattcgtattttacctcttcgggaagctggtgcagcgactccactgcattttgttccatccgggaaaccgtccagtcccgctcccggttcatcatttcataagccttttccggcacttcattcatgccgacgcccctgtacacccattcatcggcattccctttaatcacttccgtatttaaagccatcaccatctcatatgcccgttgcggttccgggccgcgaaagcaaagatcgccgaggacaaaaattttatcggcccgcttttgttcaatatcttccagcacggcttcgagcgcatgcgcattgccgtgaatatcggatataaatgccagtttcaacgcgatcacctcaaaaatttgtttcctttattataccataatgggttgcgggtttatcccgacctgcctggtttcaccactgggatccgttttcagcgtcctcattaggcggacggagcggaagaaaatgcattttgctgcgaagtggtctataatggtacaaggatcagacatgctttaagaaaggtcaggttgatgcaatatggcacaatcagaaaaaataaaattgacttcactgacaacaaaaggcggatgcggatgcaaaatcggtccggcggatttgcagcaggtgatgcggacgctgccaccgaaggcagcggatccgaatttgcttgtcgggctcgatacgaacgatgatgccggcgtttacaagctgacggatgatttggcaatcgtgcagacagtcgacttttttacaccgattgtcaatgacccttatgcattcggccaggtggcggcggcaaacgcaattagtgatatttatgccatgggcggtacgccgctaactgcgctgaatattgttgcttttccgatccataccctcgacaaagccattcttgccgatattttaaaaggcgccggtgataagtgcaaagaagccggggtcactttagccggtgggcattcgattgatgaccaggaacctaaattcgggatggcggtgactggcacgatccacccggcaaatatccgcacgaatgcaggggccaaaccgggggacaagctgatattgacgaaaccgatcggggtcgggattttgaccacttccattaaacgggatttattaacggaagaagagatcacacgcgtgaccaatgtcatggccaccttaaataaaaaagcagctgaaatttcccgggattacaccatccatgcttcgaccgatgtgaccgggttcgggcttttgggccatgcatccgaaatggcgcaggggagcaaaaatgggctccgtatttaccaagacaaagtgccggtgctgccgcgcgtgcgtgaactggcggaagcaggtgctgttccgggcggcacaaagaataattttgcccatattgaaaatgtcgtcgacttcccagaaggcatggaccaaatagataaatggattttaagtgatgcggtcacatcaggcggcctattgctgtccgttgccggcgatgaagcggaacagctgctcgaagaacttgtaaaatcaggggtggaagccagcctgatcggtgaagtcgtcgcgagtcatcccggccgtatcaaagtgcaatagtcccatcaggaaccatagaaaggcgggaaatatttgtttcaagacattaccattgaagaagcaagaaaacggatggagaaaaagcagctcacatgggtggatgtccgttccccttccgaataccggaacgcaacgattccggggagcgtgaatatccctttatttaatgatgaagaacgggcggaagtggggacgatttatgcccaatccggcaaccgcgctgcgaaagaacgcggacttgaaattttttcgaaaaagttgcccggttttatcgaggctttccgtgaaatagaaggggaaaaagcggtattttgctggcgcggcggtatgcggagcaaaacggcggcaaccgttttggatctgatggacatccatgcctaccggctccagggaggctaccgcgcctaccggaaatgggtgacaggtctgcttgaaaatatggactttcatccggttacgtatgtgctgggcggctatacaggcaccggtaaaacgtatatgctccgggcgcttgcttcggaaggctatccggtccttgacctggaaggcatggccaatcatcgcggcagcattttcggggatatcggcctaagctcccataaccagaaaacgttcgatgctttgttggcagagcgcattttacaattgaaaaatgcgccgtatattctgatggaagcggaaagcaaaagaatcggaaaagtagtggtgccggaatttttgatggaaaacaaagcgcgcggcacgaaaattatgattgaattgccggtggaggaacgggtccgcaatattttggatgattaccggccgtgggagaacaaagaagcgtgcatccgtgcctttcaaagcatcaaagaacggattcacacgccggttgcaaaagaaatcgagaaagatttacagactgaacgatatcatgaggccgtaaaatggctgctcgaatattattatgatccaagatatgaccattcgctcggaatagaggagacagaaagggtgaaaacgatccgggccggacataccgacgaagcgctcggccaattaaaagaaatgttaaaaacagccggccttccgttgcactaaagcaatggcaggccggctgtttacatgtatcactgcggatttatttggtacgccttatggatttggctcgcgggtatgccccggtcagcaatgacaatccctgcctgtcatgcccgggtaataaccgtgcatcattcccggggccatgcccatcccagcgcccgcatatcctggataacccggcatttgtccatggccgtaaccggcgcctgtgtaccccgggcccatcggcaatcccatatgctgaccgtaccccggcatgccgtacatgcccggatacatcgaagttgcgggatgctgtcccgggtacatttgccctgccatcggatattgccctgccaaaccgtctgatgctcccatctggcccatttgccccatcggaccgtaatgctgcatcatatccatatcatcatcataataaggctggcttcccccggcatagctgccgaaatgccctaacccctgagattgcggataatttccatatgtttgttccatctcaacccactccttttcggtgttcaacattagagtatgtggatcagggcgcatggttatagacatttgccccaaaaagtgaaaaaaatgcgggcaaaagcctcaaataaagattttaccggggtttaaaatatggttcgggtcaaacagatccttgattttcttcatcatcccataagcgggcccgtgttcttcacgctgatattttgcctttccaatcccaacgccgtgttcacctgtgcaggtaccaccctttgatagcgcaaatgacacaatatgttcatttaacgcctgtgcctgccgaatttcattttcgtttcccatatcgatcattaaaatgacatgatagttgccgtcgccaacatggccgacaatggccccgtccatgcccattctgtcaagcgttttgcgcgtatcttcaatggcttcgggaaggaaatgaagggggacacaggcatcggttaccatcattttctttcccggcgtgccgcggacaaaagcgtaggcaagtttatgccgcgcatcccagagcttatggcgcgctttttcatctttttcaaacataacatttttgcattggaattcggcaaggatgtctttcgcaaagttgacatcttgttttaacccggattcgttccctgtaaattccaaaaataaagtgggccattccggatacgatgtccccataaaccggtttgcctgctgaagcgaccgtttgtcaaccagttccatcctttccatcgggatcccggcttggcggatcgcgacaacagcatcaaccgcctgcctgaccgtttcgaaaacggcccttgccgcaaccattgcttccggaatgccgtatacttttaaagccagttcggtaatgacgcccagtgtcccttcagacccgaccatgagcccgtttaaatggtagcccgacgatgattttgcggcaaggcttccggtatgaatgaccgttccgtccgccagtaccacttctaaatcatacacctggtcgcgcatgaccccgtatttaacagaagtggtgccactggcgttggtcgcggccatccctcccaatgttgcatccgcccccgggtcgaccgggaaaaacaaaccatactttttcagctcccggtttaactgcgtgcgcgtcacacccggctgcacccggacaataaagtcacggtcaagtacttctaccactttgttcatccgcatcatatcaagcgtaatcccgccctgataaggaatgacatggccttcgagactggaaccgaggccaaaaggaatcaccggaatgcggttttcattatgcggttttcattggcaaaagcaaccactttccttacttgctccaccgactcgggaaatacaacagcctgcggcaaatggggtgtatgataggattcgtccctgctgtgctgctcaagaaccgtttcatttccgctgaccaaatccgggccgatcaattctttcagttttaaaataaaattttccaagcttgccacctctttatgtatatttctactttttataatatacgaaaaataaagcgctgacaaaatttttggcagtggagtgcttgaaagggatgcacaaatatttacaaaaggaagcgtttaatttaaactgtttactgtatatatttaaaacaaacagaaaaattcgaacatgcgaggggggagcggttttgaaaaggtttgaaaacagggttgcgattgtaacgggtgcaagcagagggatcggcaaagccattgcagccgcctttgccaaagaaggggcaaaagtctgtctcgtcgatatcaatgaaaaggctttggaagaaactgtaaaggctttcaaagaaagcggttacgatgtattcgggcagctggcggatgtggcaaaccgcacgcaggtggaagcggtggtttcagctgtgtgcacccggtatggaaagattgatattcttgtcaacaatgcaggcgtgatccgcgataatctgctgtttaaaatgacggatgaagactgggataccgtcatgaatgtccatttgaaaggggcgttcctcttttcaagggctgtccagcaaaacatggttgaaaataaatacggaagaatcatcaatacctcttccacttccgcgctcggcaaccgcggccaggcaaactacgcggcggcaaaagcgggcattcagggctttacaaaaacgctggcctttgaactcggaaagtttggcattaccgccaatgcggttgcgcccggctttattgaaaccgacatgacaaaagcgacggctgagcggctcggcgttaaattcgacgactttatcgcatttaatcaatcgatgattcctgtcggtcggacaggaaagccggaagatattgcaaacgcggtccttttctttgcgatggaagaatcgtcgttcgtaaacggccaggtgctctatgttgccggcgggccgaaagcataataagggggcgggcggatgtttgaagaactgattggaaaacggtcaaatccggtccaaaatacgatcgaaaggggcgctgtcagaaagttcgccgaagccatcggtgacccgcaccctgtttttacagatcctgcctttgcggctgaaaaagggtttaaagccaacatcgcaccgccgacattcccggtcacgtttgactacgggataatagaaggcctggaccttccgaaagctgggctcatacacggggaacaaaatttcgaatatcaacggccgctctatgtcggagaagcattgcactgctatagggaaattgaaaaataccaggaaagaaaaggaaagctcggacagatgggtttcttgtttataaaaagcacggcggaagataagaatggtgaaatcgtcatgaccgcaacccaaacgattattctttctgaaacggtccggaaggggatgaaaggatgaaccttcgcgcgaaaaaacccggggacagcctggaaagcatggaactcccgccggtttcaaggttggacttaatcaagtacgctggtgcttccggcgactttaatccgattcatacgatcgatgaagcagcagaaaaagccgggctacccggcattattgcccacgggatgtggacaatgggaaatctcggaaagctgtttacaccgtatgttggcgaaggattcatcgaaaaatttagcgtgcgctttgcgggcatggtttttctagacgatcgcttgacactgtcggcaacgctgaaagaagcgcaaggcgcccggcaaacgtatgaagcagtggtggccaatcaagacgggggaaaagtgatcaaaggcgaaatcgtgttcaaaatgtacggagagtaaaaaaatcccgccaggtgcggcgggatttttctgaattataactcaagccattccgtatggaagatgccttctttgtcaacgcgctggtacgtatgggcaccgaaatagtcacgctgggcctgtaagagattggcaggcagcacttccgaacggtacgaatcgtaataggcaagcgctgcggacaaagccggcacaggtacgccgaagcggacagctgtcgcgatgacttcgcgcaacgcatcctggtagctttccacgatttccttgaaatacgggtcaaggagcaggtttttaagattgcgatcgcggtcgtacgcatctttgattttttgcaaaaattgcgcgcggatgatgcagcccccgcggaaaatcatcgcaatttcaccgtaattcaaatcccagttatattcttccgaagcggcccgcatttgcgcaaagccctgggcgtaagaacaaatcttgctcatgtacaatgcttttctgaccgcttcaatgaacgcttttttgtctcctgaaaaagcgggtttttcaggcccttttagcaatttgcttgccgctttccgttcttctttcatggccgagataaagcgggcgaatacggactccgtaatcaatggcagcggaacccctagatcaagcgcactctggcttgtccatttgcctgtccctttttggccggccgtgtctaaaatgacatcgacaagtggtttgccggtttctgggtctttttttgtaaaaatatcagcggtaatttcgattaaataactgtcgagctcgcctttgttccagtcggcaaacacttcgtgcagctcgtccgcagtgaggccgaggatatttttgagcagattgtaggactctgagatgagctccatatcgccgtattcgatgccgttatgaaccattttcacataatggccggcaccatccggaccgatataggttgtgcacggttcaccatttactttagcagcaatgtcttttaaaatcggtgcaacaaggtcgtatgcttctttttgcccgccaggcatgatcgaagggcctttcagcgcgccttcttcgccgcctgagacaccggtgccgataaaatggatgccgagtgcacttaattccttgttgcggcgctgtgtatctttaaagaatgtgttgccgccgtcaatcaagatatcgcctttgtcgagaaacggttttaactgctcgatcgtggcgtctgttgcttcgcccgctttgaccatcagcaggatttttcgtggtttttcaagcgaatggacgaattcttccattgtaaaataaccgaaaatattttttccttccgattcttttaatatttgctcggtttttgaacgggaacggttgaagaccgcaacggtgtaacctttgctttcgatattccacgcaaggtttttccccatgacggccaaaccgatgacgccgatttgctgtttttccaatgtagacacctcaacatgattagattgtaaagtctttcctttgcgcgcaggtggctgcaagcaaaatggaagtcttacattattgtaccaaatatcccctgttattataaagaaaaagacagcccagccggaaaatatttatattttccgggaaagaagtgtccgtgtatacgatttccgatgaaccgggacctcgggaaagcgcgcctgttgggatttttttaaagcttacagtataatggataaagatgccgttttacggcttttaagcaaaaggaggaaacgggattgggcattattttagtcgaaatatgtgaaggcagcctgatcaacacaattgatgtggaagcagaacttgaatcccggtatcctgaagttgcggtgatttcaaatgaatgcttaatggcgtgcggcttatgcacctacagcccatttgcgatggtgaacggaaaaaggatttttgccaaaacgcctgaggcttgccttgaaaaaattaaagcagcaattgaaacggaattaaagaatctgtcgtaaatggttctcgtttcaaattgttttttatattataatgtggagtggagcattcgggatagggggatagcaggatggatatttggactgcgttcaaatacagctgtttattgccgggaaaaagagctgcttttcgtttgaacaggcttccgatggacaggacggttttgtatgtggttctgcttgttcttatggtttcctgtctgcatatccctgcgattttaaccggcggatcccttgatgccctgaatgccatccaatttgttttttactttctgttcgcttatgtgctcgttgtcctgtgcggcgtattggcgggcatttctttgctcgcttttgccggatacgggctcaggaagctgtggaagagaaaactggcctaccagcatttatggaaaatgtcatgctttgtcataacggtcccgttcattttacatacaatcattcatgaatggtttacgaaaaacggttttgtttcgggtgtggtgctgatcgggtatccgcttttttgtttggcggcgatgatcctccactatccggaaataaagaggcatcaaagcaaagaaggagaagaacatggctgaaaagacaattttacaagacttgcgttcgctcatttatccgcgtcaaattctggaagatgaaccgttaagcaaatatacatttacaaaaacagggggaaaagcggatattttgattttccccgagacatatgaagaagtgcagaagacggtccgttttgcctctctgaacggcgtgccgtacacgatcctcggcaacggctccaatctgatcatcaaagacggcggcatcaggggaattgtgctgattctgactagattagcgaaaatatcgcatacaggcaatgacattacagcccagtgtggtgcagccattatcgatgtttcgcgctatgctttaaagcaaaagctgacagggcttgagttcgcctgcgggataccgggatctgtcggcggtgcgctgtatatgaatgcgggggcgtatggcggggaagtcaaagatgttctgaaaagcgcgcttgtcctgaccaaaacaggcgagatgaaaaggcttgaaaaaagcgatttgtccttccagtacaggaaaagttccattgcggaaaatggggagattgcgcttgaagggacgttcagcctggagccgggcgacgcacaggagatcaaagccaaaatggatgaattgactgatctcagggaatcgaaacagccacttgaatatccatcgtgcggcagcgtgtttaaaaggccgcccggctattttgcagggaaactgatccaggacagcgggctccaggggaaacgcatcgggggcgtcgaggtttcgacaaagcatgccgggtttatggtgaatgtcggcggcggaacggcaacggattatatgaatttgatcaaatttgtccaaaaaacggtaaaagaaaaatttggggtagatcttgagacagaagtaaaaattatcggggaagattaaaaaatatcccggttcttttgcatgtagcaaaggaatcgggatgtttttcatcctttccggcggatatcggttaaccggtttccacggtatttgatgtacacttggtcgccaatattaaaatttaaatacgtatcgcagtcgatcgcaagcgttttgccgttattgaatgcgatcgcgcaatacggttttgtcgttgttggtgccacttttatttttcgctttgttttcacaccggttgcaaccggcatttctttccggttgggcgtgtaaaatttatcgataatctttacgcgctgatagcttaccgggcgctgaaaaaagatcaatcctgcaagcacggccagacagatgatgaataaagccagtttccatttcagtttttccattgtcatccctctactcccagaacgtctctatgaatatctttatggggctcttcattaaaatatgtatataccacaatcaaatgcttttttaaccgaatcttttttgaaactttttaaggccagtttcgtatatggattagactcgtttagcagaaagtagggatgttatgagtgaaatggcgctctcggtcaaagggattacaaaacaaatccgctcgcgcaaaattgtggaccaggtcagttttgaagtgaaaaaaggtgaggttttcggccttctcggtccaaacggcgccggtaaaacaacgattatccggatgattgtttcattgatgaaacgcacaagcggggaaatctttattaacggcaaaagccttgataaagatttcaaaggggctttgaatgaaatcggcgcgatcgttgaaaatccggaattttatccgtacatgaccggctatcaaaatctcgtccactataagagaatgtcaaggaaacccgtttccgaagagagattatgggaagtcgcaaagcttgtcaaactggaagatgcccttaaacaaaaagtcaaaacgtattcgttgggaatgcggcagcggctcggggttgcccaggcgattttgcaccagccttcgttattgatccttgatgagccgacaaacggccttgacccgcaaggcatccgcgaattcaggggctatttgcgggagctggcaggaagcggggtatctgtcctcgtttcctcgcacctgctttcagaaatggaactgatgtgcgaccgttatgccattattgaaaaaggaaaactgatccatattgaaacgatggcagaaacgacaacggtaaaacaggatgaccgccgcgatatcttgtttgcaacggatgacagcgaaagcgcgaagcagacggtggagaaacagctccattttccggtttccattgtcgatgatacgcgtattttggtttcggcagcttacaaagacgcagccgttatcaacgcaacattggtaggaagcggctgcaacgtctatgaaattcattttgaaaagaaaacgctggaagaccgtttccttgaactcacgaatcatacaacaggggaggaaaatcaatgatcgctttaatccgaaatgaatggatgaaaatatttgcccggaaaagcgcatgggtctatatgctcctgattgtcgcgttcgtgctaattgctgcactgttttacaataaggtgtacggcaaagacgatccaaactggcgtacgaaaatcgagaaagaaatcaaagcggatgaggcgctaatgaaaaaggatcctgaacaatacgcggaccttgcgccaaccatccaaaaaaaccaagattatttgaaatacaatatcaatccggatgcccattcaaactggcatttcatgaacaatgtggtcattccgctcggttcatttgtcaccttgttcagtgtgatcgttgggagcgccaacgtttcatcggaatttgcatccgggacgattaagcaactgatgatccgcccgcatgcgagatggaaaattttgctgtccaaatacattgctgtcacagcctatgcggtattgctgcttgccgttctgcttatagccggctatttgattggccttctttttcagggatccggcagtttccatatgaaaatgatagaaaatactgtgggtgacagccaatataaaattaaagaaatcggaccgcaatttttcctgaaatttgccctttatttgccgagccttgtcatggtaagcgcgattgcgttcatgctttcgaccttgttcaagagtcaggctctggctgttggaatcggcatttttgccctgtttatcacaaacacactgggtgggattattctatttctgatgaaccggtaccattggctgaaattcctgattttcccgcatttggacttgtctgtttatgcgtaccaggataaacttacagacggtgtcaccttgccgttttcattaatcacgcttgctgtttattatgtcgtttttatgaccttgaccttttggtattttcaaaaacgcgacattgcgttttgatacaacgggtaaattcaggtacaatggctgtaaaaggccgggtgaaggagggatctgccagagcaggtctctctttgcttttttaaagcggcggacgcatcaggctgtacgggcggcgcatagcgtgtgcacccgccgaataggatgataatgggggcttgcccggaccgctggaggatgatatgggaaaaaataaccggaaaaaaatcaatgcggccgttttgttcattttcattgtgtatgctgcttatttagcggaacttttgttctttatcccgtaccgccatgcgcccaattctgccagccaaaatatcattccgtttaaaacgatccgaatgtatatcctttattaccgttactttcaatttgaagtctggttttccaatctgtttgggaatattttcatgtttatgccgttcgggtttttcctgccctttcttttcaggcggctgagaaaggtctggataatgggattgctgtcgtttttggcatcggctttggtggaaaccattcaaggatatttccatgtcggaggttttgatgtggatgatattttgctgaatacaacgggtggattgtgcggttacggtatctttttactggtccgcaagcttgtgaaaaaaatcaaaattgagatttggcgttaaatatgcataagaaaagccctgcggtgaaaatctaacgaggaccaatcaatggccggcctgtaaaaggggggaagtatgcattggatgaagaaaaactggtccgatttttaaaccaggaactttcaaattttacagtgctttatatcaaactgcaccgttaccactggtatattcagggaaaaaactttttcacgctccatgcttattttgaagatttgtaccggtcattttcaaaacaaatggatgtgcttgccgaaagaattttggcaatcgggggacggccgcttgcgaccatgtcgaaattccttgaccagaagacgcttgttgaagcgagcgcggataatgaagagggcgaactgctgcagcaattaagggaggatttggcgcagttggcaaaggaaatccgggaaacggggattccgctggcggaagaaaacaaggacaatgccaccgtcaatctgctcacccgttttctgacccggtttgacaaagatatttggatgctggatgcgatggcggacaaacggtaaatgccgctgcttttttcctaagccgtgaaaaagcagcggcaaataaaaaaacagcctttccatttgatggaagggctgtttcactttatataaatgtatcaatcaaaaggaacagattcaggcatacgacgaatcctgccacgatccacgagatgatgctcgttatccggtggttcaccagttcacccatgatctgtctgttgctcgtgaacagaatcagcgggacaagggcaaagatgatcccgaatgagagaatgacctggcttattacaagcgcgcttgtcgggttggtgcccatcatgataatgagaagcggcgggatcattgtgatcgcacggcgcaaataaagattgatccgtttgttgataaacccttgcatgacgacatcaccggataatgtgccgacagaggagctggaaagccctgcaatcaaaaggccaaggccgaaagagatcgccgctgccggtccgatatgggtgtagaactcacgaaacgcgacatccagatcttccacgacaaggccgtttttataaaatacactggacgcaatcacaagcatgctcatattgatggccccggcgatcaccattgcgatgatgatgtcgatcaattcaaatttgaaaatttttcttttttccagctcgttttttccgacgattctgttttgcgtcaatgaagagtgcaaatagatggcatggggcatgacggtggcgccgagaatgccggcagccaggacaatgctttggatgccatcgaattttggcgtgacaatcccaccgaatacttttacccattccggttttgccagaaatgtttgcaaagcaaaagcgagcacgacaatcatcacaagggcggcaatcactgcctcaaacgatcggtagccgcggcgctgcaattcgaggatagcaaacgatccgactgctgtaatcaatgcggccggcaaaagcggaaggccgaaaattaaatacaggcctaaagctgcgccgataaattctgccaaatctgttgcaataatgactaactcactttgaatccataaaaagatcgacaccggttttggaaaatggtcatgtgccacttccggcaaatttttcccggttgcaatgccgagctttgcggaaagggactggattaaaacggccattaagtttgaaaaggcaatgacccaaagcagcatatagccgtatttcgatcctgccgtaatattggtggcaaaattaccgggatcgatataagcaacgcctgcaatgaaggccgggcctaggaaaggcaaaatccgttttaaccctttcacatccccccgtagtacagcttgtgcgctcgttgtattatgggacgtgcggcctggcattttttggctcatcgttttttcactcatagatgtttcccctttctttaattttaaccctgaaacaaaaaagtttccttagggaaaactttatctagtactattgtattcaatgtttgcgaaaaagtaaaccttttgcatgcattttcccctgtattttttatggaaaacatgctttttgttcattatgcccgattcctgtgctgttatggcttctgctccgggagaaaaaaggaggggagaaaaatgcatccttttcttgaaaactgtggtatatattaggtatagggaaaactgttttcacaacatggaaacgaggtttaaaaggggggaatcgattgaacgaggcattcattatcgaaaaattaaaaaggcgggaaccgtccgtttttgggatggaccgtttgtcccagtttgcggtcctgttgccgctcgttcaaaaaggcgatggccttcatgttttatttgaagtccggtcccggcagttaagaaaacagccgggggaaatttgttttccgggcggcagaattgaaacgacggacaaaaacccaatggaagccgcgattcgggaaacaaccgaggaactgtgcatggatgcgtctgtcatccgcaacgtattcccgcttgactatgtcgtttcatcatatggaaggcgcgcgatctttccgtttgcgggttttttgccggatatgccttttcatccgaatccgggcgaggtggaagaagtctttacagtcccgctttcgcattttgccaaaacagcgccggaatgttaccggattgaatttaaggtagagcctgaccaggattttcctttccatttaattcagggtggtaaatcatataaatggaacagccagcaaatggacgagtatttttattactacggggattatgttatttggggattaaccgccggcattttgaaaaactttatggatattttgggtgcggacaaagcttgaatgatgcccgtggcggctgtcctgccctttcggaaaccggaaatgccgccggaatccggcagccgggtgccttcataccgggtgttttcagcatggtctggtgtgcaggacataaaaaaactgttcaattacgtgaaattattataaaatgttgtttataatacaaagcttccgttccggaaacggaggggacttttacaattgagggaaaatgagcgatgatacagcatggcctaatcagaaatgccacagaagaagatctgcaggagattctggacatttataatgcctgcatcggaaacgggattataacggctgacacagtcccggtcaccgtagaagaaaagttgccatggtttaaagcccatcacccggacagccggccgctttgggtgttggaagcagacggggagattgctgcctggatcagtttaagcgatttttacggaaggcccgcttaccagcctactgctgaggtcagtatttatgtcagcgaaaaatggagaggaaaaggagccgggaagcacctgctcgggaaaatgttggaagcctgcccgaagctaggggtggaaacactgctcggctttattttcagcgaaaacaaggccagtttaaagttgtttgcatccttcgggtttgaaacttgggggcatttgaaagaagtggctgtgcttgacggacgcatgcacgatttaatcatcactggtaaaaaaattcaaggattttgaaaggcttaaggagctataaagttatgaaaatagaattatggtcggatttttcatcggcagattcttatcttgcctttgtaagacttggcgaggcactggaacaatttggccacagggaaagcattcaactggaatttcgcagtttcgtgaaaaaccccgaaaaagaagtacatattgaagagagccataaattgctgcactttgcaaaacaacacgggaaacagacgttcattgcgaaggcactgtttgaaacgtatgcccggcagccttcaccaggtacaggagatttattacatgctgcccaaatggccggactgaataaaagagcggctgaaaaagccattgtaacggatgtttacttggagcatatcaaaaaagaccaggcagaagcagatctattgagcgcgaattttgccccctttatggtcatcaaccggaaatatgcgatttcgggagcccgcccggttgattttattgttcagtccatgcatgaagcatggcgagaagaaacctatgtggcggccatataaacatgaaaaaagcgcccggtccggggcgcttttttccaatctttcttgcggcggctaaggcttgcactccacattgtgcattccaaaaaggttgccttgccggcttatgcaattcagctcatcgctataccaatatagcatgattttaaacgaaaaacaagcgttttggcggatttccgtttattaccacaaccaaaaaaggccgggaatcatcccggcctttttagtatcctcaccagcgatgcgcttttgcattgctcctcaagatgatggtgttttgtgtaacttccgtctcgccattgacctgggaatttgtatgtttccgccgcgtccagttgtaatggaacaactcggaatgcggatccaactggtctttgtagctcatacgatcacctcttggaaggatttggataccgctgatattcataccgaatatcaattctagcttgtgcagaaagggcaaaattacacatcctgtgtgttttgggcaaaatccggctgaaaggcagagcaaaaaaatcaaaagacacaatgtgctaaaaactcatacattgtcacattttccccatccatatcaaggttaagatgtacgtatggcacattgtactaataacagaaaatgatcaaagccgcaattatgccaaattggaaaccatgccgcgcctaaataatcaaattacactgtgtgctgataacacaataaaaacaaaaaccaaaacaagcatttaagggaaaggaacggaaaaaactccgggatgccggaattcaagcgggcagaaacgggcaaaaaaatcgggcttgattaggctttctatataatcatccaacaaatgcagacataatatataaaaaacaaccgtccaggaaaagaaatggctggcaatggcagcaacgccgtttgtcaaatcacggcttttcccggcttgaatgcatctgcaaaaagcaaagatcttcttgaaagcgctttaaaacaggggagttatgttggaatggttataaaaggatcagcctcttgccaacactaatggtatggatcaactttttggaggtgaagattgatgaacatcgaaaaagctgttgaggtcattgaccggatgcgcctgccaaacggtgcctataccgccagtttgtcttccgactaccattatgtttggatcagagatgtcgtatataccgttctgccttttttagccacgccgtccccgtattatgaaaaagcataccaggcattgcttgatctgtttatccgctatgagtggaaaattgacattcatacaaagaaaaggccacggtatttatacgaatatatccacgcccgctattccactgacctcgaggaactcccgcaagaatggggccatgcccaaaacgatgctatcggtgctttcctttggggcgtaggggaaggcgtccaccacggccaaaaaatcatccgcagccagaaagatttggagattatccaaaaactggttgactatctcgagtgtctggaatattggcaggccgaagataacgggatgtgggaagagaatatggaagtgcatgcttcaagtgtcggggcatgcgttgccggcttaaaagcagtcaggatgctcgtgcatgtggaggatgggctgattgaaaaaggggaagaaacactttataaactgctgccgcgggagagcgcaggcaaaccgaccgaccttgctttactgtctctcatttacccttaccggattgtcagccgagatatggcgcttcaaatactggaagatgtcaccacaacgcttgaacggaaatacggcgtgatccgctatgtcaacgaccaatactataatgaaggcgccgaagccgaatggtgctttggttttccatggcttggtttatgtttctatgaactgggtatgtatgataaggcaaatgaatatgtggaaaaaaccaaaagcatcattacggaaaattgggaaatcccggaactttatatcggcggcaagtacgtgccgaatggaaataaaccgcttgcctggtctgtttctttggcgtaccagttcttcaaaacaatggacgtccgttaaacaattgaacagccgattttaagctgttttaagtcgcgacccgcatattcattgcatgtcaaaccaatgcggcgcatttaaaacagcttttttctattctgaaaatatacgccggctgattttctttttccactgatgcagcgttcactgcagcatgggcgtctattgaaaaacggaatgacgaatttgcaaataaaatcatattgtttccatttcgacaaaattagacggctttttttgcaggattcgtaaaattcataacgaatagtaaaagtatgctgaaatagcggaggtgtgacattggaaaactcagttaagtattcgcaacaagtcctgcccactgatttcgagctttatttattccacgaaggcaccctttacgaaagctatactttgttcggggcacatgtcatggagtatgaaggaaaaaagggcgtgcggtttgcagtttgggcgccgaatgcgcaagccgttgccgtagccggcgattttaacggctgggacggcagcaaacaccaaatgaaacgactaaaagattcgagcatctgggtgttgtttattccggatctcgcgccgggtgagctgtataaatatgaaattacagggccttccagcaacactttttttaaagcggatccatatgcgttctattcggaagtgcgtccgaaaacggcatctgtcatttatgatcccggcacatatcagtggcaggatagaaaatggatgagccacaaagcaaaatccgatccgtaccacgagccgatgctgatttatgaaatgcatttcggttcatggaagaaaaaagccaatggcgatttttacacctaccgtgaaatggcagacgaactggtcccatacattgccgggcatggctatacgcatatcgagctcatgccgatgatggagcatccgtttgaccggtcatggggctatcagattaccggtttctatgcaccgacaagccggtacgggaagccggaagatttcatgtattttatcgacaaatgccatcagaacggcctcggggtgattttagactgggttcccgtccatttctgcaaagacgcccacggactcgggcgctttgacggaacaccgctgttcgagcctgcagaccctgacatggcagaacggccgatttggggtacatacaattttgactttcagaaacctgaaattttcagttttcttatttccaacgccattttttggatagacgtttatcatattgatggcttccgggtggatgcagtttcttctcttatttatttaaaccatgacaggggagacgaaaagaaattgacaaaccaatatggcggtgatgtcaatttggaagctgtcgagtttatcaaaaaattaaatgaagccgtttttaaaatgtttccgcatgccttaatgattgcagaagaagcaacatcgtggccgctcgtaacagcgccggtttacgcgggcgggctcggttttaattataaatggaatatgggctgggtgcatgatgtgctcacctatatgcagacaccggaggaaaaaaggcctgatgcccatgatctcctcaccttttccatgtactatgctttttcggaaaactatgtactgcctttttcgcatgatgaactggtttacgggaagaaatcgctgctcaataaaatgcccggggatttcccgcaaaaatttgcaaatttacgccttctttatgcttattttatgacacatccgggtaaaaaattattattcatgggaagcgaattcggacagtttgacgaatggaaagacctgacgcagctggattggatgctgctggattttgaaacgcaccgtaccttctttcagtttacaaaagccttgaacgcattttatcaaaacacaagaagcttgtggcgcttggaccatgaccctgaaggttttgaatggattgatccgaataatcgcaggcagagcatcataatttttatgagaagagggaagcggaaaggggattattgcatcgtcctctgtaatttttcaaaaatcaaatatgacaaattccgaatcggcgtgccttcatttgggaaatatatcgaaattttcaatacggatgatgaacggttcggcggcagtggtttgttgaacaaagaagcaatccaagtggataaggagccttttcataaccagccatacagtatggaaatcagcattcccccactcagtgcattgatctttaaaaagcaatcaaaaaaacggcaaaggggtggcaaaaaataatggcagaaaagaaatggatggcaatgctcttagcaggcggacagggaacaaggctcggggatttgacgtcccagctggcaaaaccggcagtgccttttggcggcaagtacagaattattgatttttcactaagcaactgcatgcactcgggcattgatacggtcggtgtgctgacgcaatatgaaccccatcttttaaactcgtatgtcggaaacgggaaagcatgggaccttgacaaaaatttcggcggaacagccgtgctgccgccgtatgtagggaaagacggcggcgaatggtataaggggacagccaatgcggtttaccaaaatatccagtatattgaccactacaacccggaatatgttgtcattctttcaggcgatcatatttataaaatggattatcggaaactgttaaaatcgcatatggaagcaggggcgcaggcgagtattgccgtaattgaagtcccgtggcaggaatcagggcgcttcggcattatggtaacaaacgcagaaggaagaattgttgaatttgaagaaaaaccgaaattcccaaagagtaatctcgcgtctatgggcgtgtatttatttaattggaagcttttgcgcgaatatttaatacaggacgagaaaaacagcgcttcctcgcacgacttcgggaaagatattattccgaaaatgctgaaagataaaaagaaaatgtatgcttataaatttgaaggttactggaaagatgtcggcacggttcaaagcttctgggaagcacatatggacttgctggaagaaaaaccggcatttgatctggatgatccggactggcgcattttcaccggagatgcgaaccatcctccgcaatatattgcgccccaatccaatattaaaaacgcactcatcaacgaaggcagctggatttacgggaatgttttccattctgtcatctcggatcatgtttatattggcaaaaacagtacaatccaggattccgtcatcatgccgaatgtcacgatcggcagcaatgtgaccatcgaacgcgccattattgcaagcggcaccgtcattgaaaacggcaaaaaaatcacgccttcaaaaccaaatgatattcagttgtacagctgtccgcaaaacggcgaagaagcggaaataaaagaagttttataaagagggacgggtgaaacatgacgaacgtactaggagttatcaatttgatcaatgaaaagccgattttaaaggagctgacaaaacaccgctgccttgcttccgttccgttcggcgccagataccgcttcattgattttgcactttccaatctcattcatgctgaaattacccaggttgccgtttttacgaaagacaacggcagatcgatcatagaccatattggttccggaaaggaatgggatttggaccggtacgacggcgggctgtttatcctgccgccggttgccgatgatgcaaaattgaagggggatatccagggcttttatgatcatcgcgaattctttgaacgggcctcggcagaccttgtcatcatctcgccgggaagcaacgtcagcaaactcgatatttgtgagctggtcgcatcccatgagaaaagccaggcggatatcaccgttgtatacagaaaatatgacggggagccgatccaaaaaccgaactatcatcaagtagtggtagataaagaggacaacgtacgggacatcgaactgtttaccgctccgcaaaagggtgatcttgtctgcctggaaacctatgtgctgtcaaaaccgttgctgatggatctcatccaaacctgttatgaaaacggagaatatgactttttgcgggatgcgatcaaagcgaatgtccataaatttaaaattaaggggtatcaccaccgcggcaatatgatctttatccactccatggacagttaccacgcggcaaacatggccatgctcgacccggatacgatccgcgctttcttttacagcgactgggaaattctgaccaagatcaaacatgagccgccgacaaaatacggacaaacagcggacgtaaaaaattcatttattgcgaacggctgtttaattgaagggacggtggaaaacagtattattttccgcggcgtaaaaatcaaaaaaggaacagtcgtgaaaaacagtatcatcatgcaaaaatcagaagtggaagaagatgcggtattggaaaatgtcatcgcagacaagcaggtagccgttacccagcataaggtggttgtcgggaccccgtcgcatccgacagtattatccaaaaaagagatcatttgatggaggagacaagatgaacgtattatttgctgcttcagaatgcgcaccatttattaaaacaggggggttgggcgatgtgatccaggcattgcccaaagctttgaaaaaagcggggatccatccggtagtcatcctgccgaaatatgaagatttacagcctgaagtgaaagcgcgcctctcctttatgaccagcctgaccgtgccggttggatggcggaagcagtattgcgggattgaaacattggaagaaggggggatccgttattattttttggacaacgagtattattttaaacggcatgggagttacggctatttcgatgatggcgaacggttcgcctttttttcgcgtgcagtgcttgaagcccttccttatttgaatgaaaaaccggatgtcattcattgccatgactggcaaaccgggccgattcccgtactgttaaaagcgcatttttccagccatcctttctaccagggcatcaaaacgatgtttacgattcataatttgcgctaccagggggtatttccaaaaagtgtcctgtcagatctgctcgatttaagcgaattatatttccatgtggatggtcttgaattttacgggaatgtcagctacttaaaggcagggattgcttatgcagacgccattacaaccgtcagcccgacatacgcccgggaaatccagacgccgtattacggggaaaatcttgacggctttttgcggatgaaaagcaaccgcttggaaggcattatcaacgggattgatacggatgcttacaatcccaaaacagacgatgcactgttctttacatatgaggactacccgggaaaattaaagaataaaaaagccttgcaggaagccttccatttgcaagtggattccggcattcccgttatatcaatggtgacaaggctggtagaacaaaaaggcatcgatctggtgctgcatgtgatccatgagatgttaagtttaaatgtccagtttgtacttcttggcacaggcgagcatcagtacgaggaagcattccggcatcttgaaagccagtatccaggtcaggtatccgtacatatttattttgatgaagccctttcccataaaatttatgcgggcagtgacttgtttttaatgccatccaaatttgaaccgtgcggcatcgggcaactgatcgccatgcggtacggcacattgccgcttgtgcgtgaaaccggcgggctgaaagataccgtaaagccgtacaatgaattcacgggcgaaggcaacgggttttcgttcacaaactataacgcgcacgatatgctgtacacgattgaaagggccgtttggtttttccgctaccagccgaaaacatggcagtcgttatctgaacgggtgatggggcttgatttcagctgggtacattctgcaaatgcatatatccggctgtatgaagagttatgcccgtaaagaacggggagctcttaaacaaaatggaaaaaggcgcctgcttcgtactggcgccttttactgatgcccatgtttgtttctccggctgatggcctttaaaatcgataacttatcttgaagcgttaacatattccagcttccgactttgattttcacttttcccacccccccacacaaggattggcgaacatcgattgtacttgtataataccgcttttttcttcaatacaaacaccaaatatttctacaaaaattgcgtatttcttgccgcattttttctttaacattagaataagaacagaatatccctttaaagcttatggcttttcaggtgaatttgtctaaatatggaggcttttgtcatgaagataggttggatcggtctagggcatatgggatctccgatggcccgccgccttttagatgcgcatttcgatttgtttgtgtataatcgcacaattaagaaaacggaaaaactagctgaagccggcgcagccgtttgcaaaacgccgaaagacatcgccgaaaatgcagacgtcattgtcacgatgctgaccaatgccgcggcagtagaaaacgttttacaaggagaggacggggtgcttgccggccttacgaaagggaaaacagtcgtggatatgagtaccgtcagcccttccgattccatccgttttgccaaatgggtggaagaaaagcgcgggcattttattgatgcaccggtatcgggttcagtacagcctgcaaaagaagggaatctcgtcattcttgccggcggccggaaagaagagattgatgctgtgcgccccatgtttgaagtattaggaaaaaccatcattcattttggcgaaaacggaaaaggcagtgccgcgaaattatcgattaatttgctgctcggcctgacgatcgagggagcgtccgaagccattctcttcggggaaaaactagggcttgaaaagaaggatctgattgaaatgatttcggcttctgcatgcaatacacctattttccaaatgaaaaagaaggcatttttacaagaagattttccggctgcatttatgctcgaattaatggcaaaggatcttggccttgcaaaagaggaaatcaaaaaagccggtatgtcgctgccactggcggatgcagccgaaaaaacatacagccgggcgaaagcagacggaaccggaaaagcggacgtcgctgcggtttatcaagcattaaaacagctgaacttttaaatgcaatggaggagaaaccggggatgaaatttgtttcttggaatgtgaacgggctccgcgcctgtgtaaaaaaagggtttcttgcattttttgcagaaacggacgccgacattttttgcgtgcaggaaacgaaactgcaggcagggcagatcgcccttgatttggacggctattatcaatattggaattatgccgagcggaaagggtattcaggcacggccgtttttacaaaaaaagagccgctttccgtgcgctacggcgtcggcgaagatcggacagaaccggaaggccggattttgacactcgaatatgaagatttttatttggttaatgtttatacgccgaattcccagcgcgatctagcccgcctcggttaccgcctcgaatgggaagaccggatgcgggcctatttaacggagcttgacaaaaagaagccagtcattgtatgcggcgatatgaacgttgcccatcaggaaatagatttaaaaaatgcaaaaaataacgttggcaattctgggtttacagcggaagaacgcggtaaaatgaccgggctgctgaacagcggatttattgattcgttccggtatttttatcctgagcgggaaggcgcttatacatggtggtcttatatgaacaaagtgagggaaaggaatatcggctggcggattgactattttctcgtatccaaaagactggccggccgtttaaaagatgccggcatgtatccggagatcatgggcagtgaccactgtccggtatttttagaaaccaatttttaatttgcaggatccgtttctgccgattgcccttttgtgccgtgcgcccaaacttaaagcccggtactcttccgatttaacaaacatcaagcatccggtgttttccgcccgggtgcttgatttattccggacacaggcggggttctctttttgtgttttgcggcataagataaaaagcgaaacttgtgcgcaatttgcaaattcagggaggcttaaaatggcagtcgtaaaggcatcaagtgcagacatcgatttactggcacggcttttaagggcggaagcagaaggagaggggcagcttggcatgctgcttgtcggcaatgtcggcgtaaaccggatcagggcgaattgttcggattttatcggactccggaccattccgcaaatggtttatcagccgcatgcttttgaagcagtgattcacggatatttttaccagcgggcacgggaaagcgaacggcggttggccagacgtgcgattaacggcgaaaggcattggcccgccaaatacagtttatggtatttcaggccgcagggggactgcccgcccacatggtacgaccagccgttcgttgcccggtataaattgcattgtttttacgaaccgacagctgaaacatgcgaaaatgtgtataccactttttaatttgcgagccttttttcgtttggcaagaagcaggatataacagcaccgatcatgggcaagaaagataaaatggtaaatacactggcaaccccgaacatatcggaaacgccgcccatgaaaactgaaccgatcccgccggcgccgaccccgaaaccaattgacaggccggatgcaagcgcgatatttttaggcaacagcttttgcatatagatcacgccgacagaaaagcttgaaaggacgctgaaaccgaaacagagcaaatcgagtacagccagccagccgcttaaatgcggaagcagcagtgcaaaaggcgtggcaaggaacatggacacgacaagcagccgtttcatgccggcccggtccgaaatcatgccgccaaaaagtgtgcccagtgccccggccccgacaaagacaaagttcaatagttcgctcatttccaagcttgcatgtttcatgtaaaacggaagaaaaatgacaaccccgacctggcaccaggaacgcaaaataatgaccagaacaagcaggatgacgccgggaatatggttttttccggcgatttcttttctccggcgctggatattttgcactttgctgttcatccagccaagtaaaggggcggttaaaataagggataaaagagcaaccggaagcaaccagatcaggccgtgtatgccggtatgtaccaaaaagagcggaatcataagcggcccgaaagcctgtccggcatttccaccaacctggaatattgcctgtgccaatccttttttatacccggacgcaaaatgggtgccgcgtgatgcttccggatgaaagacgcctgacccgaatccggaaagcgcaataaaaagcaaaagccatgtgagtgatggcgcaattgcggttaggctcaggccggcaatcgataaaaagacaccaaacgaaaaaagccagacccgtggtttccggtccgtcagtatgccaaaaaccggctgtgtgaccgatgaagtaaaataagaaaccagcacaattaaagtggattgcgtataattcaaatggagcgcatgcttgtacatgacaacaagggcagggaccatgccggttgtcaccaggtcatttaaaaaatgcgcaccgctgaacgtaaacagcgcacggcgaaaaaaaggattttctgcctctaacggcgctgatgtaaatgattgacttcccatacatactcccactttctcgtaatttctttcaaatcgcccaggagtggacgaagacagccagacccacaacgagagctgtatgaatattgtaacataatttgccactaaaatgacaaaaagaaccgctgcgctaaggttcatttgctatcgtatagcgtttggattttcactttttcgtgcaggtggccataagattaaagaaatagagagggggatatccacatccggttcaaaagggaggaggcccttttgaacggaacggggaggaataggggacgtgtgaaaaaaacaaatgaagaaagttatttgaaagaagcatagccgtcatcaagcatgacaacacttccgttaatgacatctgcttcttcaagcgttaatagataaaccgcatttgcaatggcttcaggacggatcagttttttgcgcatttgctgttctgtcattttttgtgtcattccggcatctttatatgcctgtataatcggcgtatccacactgcccggtgcaatgccgacgacgcgaataccgtattgtgctagttcaagcgcagcattttgggtcatcatccggactgcgccttttgcagcctgatatgggaaagtaccgaagctggccaaatatccgaatacggaagctgtgttgataataacgcccttgatatccagctcgcgcatttttctgccggcagcaatgactccgtatgcaacgccgtgctgattgacatcaatgacacgcaagtaatcttctattttcaggctcaggatatgcccgagcgtgccgattccagcgttgttgaacatcacgtcaatcgtcccgtatatttcaaccgcctgattgacaagtgattcaacctcttcgaatttggaaacatccgtcttggcaaaaacagcatctccgccttcttgtttgatcaattccaccgtttcaagccctttttcttcatcaatatcggtaaccacaacggaatcgcctttacgtgcaaaagttaaactggtttcccggccaatcccgctgccggcgcctgtaatcactgcaactctgcctgacatgatgcatgcctcctgatggatatattcttagaaaaagtatgcgtttacttttctttacaatttttagtgtatcaccgcaagaaaaggtttacaataaaaggaaagaacagttcgaaaaatcgacttatatcaatagacaggtttaaaaccatcaaaaaaggataaacacttgcagttattttaaagaaaaggcaggcgaaaaatgaaaccgatgaggaatgctcattcatgcacaaatataggaaaatcagccagaagaagaattttaaggcaaaagaatgtgcagggattgcaaataaaagaacaaaccaagattagatgattcaatgaaagcatgtgcgaaaatgtaactggagatgaaaacgcaacaaccctgagtgatggaataaacctggaacgatcaatgaaacgcataccggacaaaccgaaatcctgatgagatgaaaagatgcaataaagattgtgtttcacggaaaaattgtttctgtctcaatgtttaaagtaatcttcttttttgagacaaaatttcgttttactcctcaactagctataatatatattatgttaactagataaaaatcatcacattgcggagttgcccggccactccttttcccttgtacccagagattatctttggccagaatcgttttcacctaaaaaatccgctgtataatgcagcggattttttagatcaagcctgaatatacgattttccggtttttaccgatgccattgtattttggatcgattttgccgattcgtgcagccaggatgtttcctgttcatcgagttcaatttcaagctgttgttcgatcccgttacggccgatgacacttggtatgcttaaagcgacatcaccgttatatccgtactgaccatgcaaagtggctgaaaccggataaatgcttttttcatccagcatcacggcttttgccaatgtcactgcagcttcagcaacaccggcattggtccaccctttcccattcaggacatcaaaagcagttttcaccaccttttgtctgaaagcttccctgtccaacggttcttttcctttaaacacgctgtccagttctttttcacggaatccctgtacatttaaacgactgaaaaccggaaatgcggtaaacccgtgttcgcccatcatataacccgttacacttttcggatcaatgctgtaattttcggcaacaagctggcggaggcgggccgagtcaagcatggtgcctgttccgaatatccgccctttcgaatagccaaattcattttcagcaatatagacaatcgtatcaagcggatttgtaatgaaaatgatgacagcttcttttgtatatttcgtaatccctgccatgacttcccgcaccacggcggcattcgtcctggcaagccctgcccggtccggcatttcgtctttttccgacggaagcacgcttggccctgctgcacaaataatgacgtccgcatcggcgcattccgagtaatcccctgctttcacgcttgtgtttggcatatatgtaagtgccgtggcatgtctccaatcgagcgcttccccaaatgcgacccctttctttttatccaatacagcaatttccgaaaaaaggcccagtttcatcgcatttgcaagcacatacgaaccgacatgcccaacgcctgcaactactaattttgtctttttcacagttgtcttccctccttgttttctttattttaacatttaaaatcatactattgcagtgaaaatttcgtaaaccggaaaaacggcgcaaaaaaagctgcccggtccgcagtacggcaggcagctagcttcatgattattttttaaaaatggttgaaatcactttatcgtaactcatcgtgctgtccacgacataagtaccagggcgaagatgattctcaacacccttcttttcgacatctttactgaattgaaatgcatcatccacgatattagctttctcaagcaatttgccgacatcaatgctcgtcatcccatccgtcacctggaacacaacccggttgacggttttggttttcgcggatttttcagcggatgacttcgcatcagccagatctttgtcatatgcagccttggtttgaacgacatatcctgcatgctctagtttgtctttcatctggctgttggagagttttgcagtttcagccgtatttgtttttttcaccgtattgtccgctgctttgcctgtttcggaaaaataaacggcgcctgttacagccgtggcgagcaaaatccctgcggcaaagctgctcaatttattcattcccaccggcaaccttgctcctttcgtttttcgccgccataaacggggccagaatttcctcaatttccgcttttgtcacttgttttttttctgcaatgctttcaatagagtagttgcgtttatataaatccagcacttcaagcctgaactgtttatcaaaggcagaaagctggatgccggcttctttttcaagaatgtccatttccagttcaagcgtccggatgccgtctttcagatgattgatttcatccatgagtgccaaatgcaccgtttccaattcctgctgttcctctttcgcacggttccgcgttttaaagatggacatgatcagcaacacaacggataccgcaaataaaattaccaatgtccagaccatcaaatatgtacccctccttcaaaaatcttcttcctgtaccctattattatacatgtccagccttttattttcgataaaaaacaagaatttatgacaaaagttgcacaaaaaaaacaccagccggaccagcggctggtgtactgttctttaataatacggtgccatcatcaagtaaacgatcacgccggtgatgctgacataaagccagattggcatcgcccaacggacaatttttttgtgctttttcacctgcattgtccatccccacacaagtgcgaacaaagcaagcggaacaataatggccgcgagaaaactgtgggtaatcaagataaagaaatagatgaaccggattgccccttccccgccatatcttgccgtttcaggcgaaagataatggaatgtcaaataagaaagcaaaaacaaaaacgttgacgcaaaagcggccagtacaaatcctctatgcacattgatatttttccgtttaatggcgatgagcgcgcagacgagaaaaataaacgtaaagctgttaaaaacggcgttcatcctcggcaaaatataaatatcaaatcctactttacccttgtaaccgatgttcgtaaaaaagagcagcaaaatgataatatttgcgataagggaaacggtgataatcagcgccgtaaaatttttatcacttttcggttggtaagaaggactgttccctttattcatgttttcatgcaccccgcattttatattctgtaatcatatgctttcatgatagcatgaagattggtagacaaacaacaatagcgaagtttttcacattcatttttatttgtggtaaagtaaaagtgaaaaattatacatactggagcgaaatgatgggacactatgaagcactttttttagatgtagacggaacgattttgacaccggaagatacgatccagccttcaacaaaaaaggccgtggtcaaagcaaaaaagcacggcatggaagtcttcctggcaaccgggaggccgcttcatgaaatttcgtggctgatggacgaactggaaatcgaatccgcgatcggctataacggcacacttgctgtctatagaggaaaaaacctttttaaaacggtaatggaccctaaaattgtcgataaatttattggcattgccgaaaagcacggacatgaagtcgttttgtatacggaccggcaaaactttatcacttcttttgatgtgcctgaagtgaaaagttttataaaaaaaatccaccttcgccaaaacgccccttttacaccggcagtacttgatcaagtattgggcattacgcttgtgaatgtccggggaaacggcgccgcattgtatgcagatttgcccggcctgcatttatcccaggtcaacattgatggattcaggcattgttacgacgttattcttgataaagtgaataaaggcatggctgtagccaaaaccctggatatcctcggcattccaaaagaaaaagccgttgcgtttggggacggcatgaacgataaagaaatgctggaggcagtcggcgaaagttttgcgatggcaaacagcaaccccggactgtttgcttatgcaaaacaccggacgacaagcgttaccgaatccggtatttaccatggtttggaaatgctcggggtgatcgatcaagcataagggggagcgtccgtttaaacggtgaaggccgttcaaactgcctcttccctttttaacttccgcgataggtctgatacccccagggagaaatcaatagcggaatatggtaaccggcagccggatcagaaatgttgaaccggacaggcacttcaccccaaaaaggcgggtccggaagatttgctccctggctgcagaaataatcaccgatagaaaaaacaagctgatacaagccggaatctattttctcagcagataacagtggggcatccgtccggccgtctttatttgttaccgttttggcaagacaccgccaccttgatgttgccggatcaaatttaaataactgtacttttacatgttcagcaggtttgccatgtgttaaatccaaaatatgtgttgttaaaccgggcatatgcgccatcctttctttacaactcagcggaggcaatcgctttttctgtccaattgccggtaaattctatttcacggtaggaaaaatagtcttttaatatttgttcccggtcatcaaggaacagttgatctgcaacgccttggacaactttcgggattgcaaatcttaagcctgataaagcggaagcagacaacccacagctaatgagggccgaataattaaaagcaaacaaaccatagagtatccgcctccccttttcattgcggctaaggaaagaaaaatccggactaaggtatggatgcgcatcaatcaaaggattttttattttttccggcgcactgaaccgatcctgccagcgggcaatatacggctcaaccagccgcaattccggccgcaatgatggattggaaacaagaccggtggcaatgattaaaaaatcaaaagcaaacgctccatgcggggtggtgacaactgcctgtgttctctcttcccttacatccagccacggtgacccggtatggagccgaaagcccggccaggcgctggcacggttaaaaatatcatttgtcggcggctggctatacttgaaaaaatgggccatcgctgcgtatttatctttatcagacaaagtatggtaccgttcaatcattccggaaagttccatctggcgaatcgggttaatccgctttaaatcgtttcccctgataaatacatgggcctctgccgccccttctgcaagcacatggttcgcattgtcaaaagcagatgcaccgccgcccaaaatgccgatcttctttcctctcagcttttccatttctatcctttgcgatgtgtgggcatacaaataggacggaagtttttcctttataaagtccggcacataccattccccgccgccctgaattccggtggcaaggatgattttccgcgcaagtaaaaatgaagaaggtgcccctttcccttcaatctgcagcctgtgcacccctccttcaggcgctatacaggttaaagtaacttcgttcagaactgggaggcgaagcactttcctgtaccagcgtaaataattcatccattctcggcgtgggattttgtccagctcgtcccatgctttttctccgtattgcgcttcccaaaaggccctgaaagtaagtgagggaatcccgagatcaatggaggtcaggtgttttggcgttcttaacgtcagcatccgtgcatacgtatcccacggtccttcataaccattgggattttcatcaattacaagaatattggagatccgctcttttaacaaaccaaatgccacgccaacgccgcactgtccgccgccaattataatcgcatcatatacatggccttcctgatgaacaaccggccgaacccagtctgccccgccaaacgctaggcaagatagatctttttgtacccgtttattcagtgcttccaaactcatcactatttcctccattttcgttcgattggttaaagagcgcagtaaacctgaaataagcaatttgataaatctgctccagtgcggtttgaaattcttgttcgctgctgtggcaaagccgctcgcgcattgccgcgtaaatctcttccttgttttttccgcgaacggccaatataaaaggaaagccaaattttttcttatatttttcattggctctttgaaactttgtatattcttcctttgtcaggttctgcagcccggattccctttgttctgacgccgaatgcgcgctcatcctcatcctgccgcctaaatccggatgtgcccggatcaactcccgtttccggtcttcccctgagtcttccaccatttttaccatcttccggaataattcatccggcgaatggtaaggcctgccagctgctgcttgttcggcaagccaccgggcatgttcaaatatcccttcaagctgctctataaatgcatccttcgtgatttgattgaattcatggatcgtcgccatcttcatccttctttcaaagccggatccacgacacgtacgggaatgtcagaaggcgcacgcacgcggtcttttttcggcaagagcaagtttaaaataatggcgcacaggctgccgcagatgatgccgtcattcaccaggattctgagcatgggcggcaaaacatgaaataaatccgggacaaccgtcgcaccgagcccaagcgaaacggagcaggcaatgatcagcaaattgctgttttccgagaaatcaacattccgcagcatccggatccctgaagacacaaccattccgaacatgacaaccgttgcgccgccaaatacagcagttggaatgatcgtcgccaatgcggcaattttcggcagcactccgagacagatcaggatgatgccggcagcaatcgtgatttttttcgttttgatgccggcaagctggacaaggccgacattttgggaaaaagtactgtaaggaaaggcgttaaaaatccccccgaggataaaagaaattccttctgcccggtaaccgtttgtaatgtctttaccggttaatttcctgtccgtcatttccccgagtgccagaaaagcaccagtggactccaccagaatgaccgttccgacgatgatcatcgtgatgacagggacaatatggaatgccggcatgccgaaataaaaaggggccggaacacggaaccaggaagcttccgcaacgactgtgaaatcaaccttccccataacggttgcagcaattgtgccggcaatgatcccgagcaacacagaaatggcgcgcaaaaaacctttaaaaaagcggttcataatgaggatcagcgccagcacaccgaaggaaagcagcaaattttcgggagatccgaaatctttactcccctgtccgccgcccatattgtttataccggtcgggatcagggataatccgatgatcatcaccaccgtccccgttacgacaggcggaaatagttttaacaatttcccgtatactttggaaaacaaaataatgaacaaacctgcagcaataatggcgccataaatggcatgaatgccgtatccggtgccgatcgtaatcatcggggacacagcaacaaaggaagtacccatgacaaccgggaggccgattccgaaccattttgatgcccatgattgaagaagggtcgcgagcccgcatgtcagcaaatctaccgagattagaaatgcctgctgctcgggggaaaactttaacgcgttgccaacgatgattggaaccaaaatggcaccggcatacatggcaagcacatgctgaaggcctagtgaaaaaatttttgaaatccctgttttctgattcaattccattcctcctttattcatggataatttaataacatattggagttatattatttaacatgatagtccctttgcttttgatgatcaatggataaattcactaaaaacttgcatttttactggtcaatttaaataaaaagcaaagatgtatgtgaggttttctcacaaataaaaaaagagccacacgtcagcatggctctaactgccgattggctcaagcagattgtggatccgaagcgccaatcgcagctgcagattggtatccggatcttttaaattttttccaagcagctccctgcatttttcaatcctgtaaacaacagtattgcgatggacataaagccgtttggacgtttcagatatctggcagtttgtttccaagaatacagataaagtctgaagcagcgattcccgttcctctttttttatgcggcgaaagcctttaaacgcatgccggtaaaagttttccagatcttcacgcgggatgaggcgcagcaatgacacgatatctttcgttaaatacgtttggatatatgcggactttctcgacaattcaccggattttaacgcgtctatggcttctttataagcactccggacttctaaaaagctatggctcaaattgctgattccaaatgacatcgttcgtccgaaataagcctgtactttttcctggattttatgcagctgcgcttctatccagctgctgtcatatgtctgcacctcatagagcagaatacagagctcccccttcgtaaaaaaatgagcatcccctggcgaatgtgccacgtcgtcttctataaattcataaatttcatcctgaccatccaataaaccgccgtctatttttccggcaacgcaaacatatgcctgatcattgcgcaaagcaaactcagcagcccgatttatcatttccgcctgcgaagagaacgccccttcaagaaaatgaagaaaaaaatcattccggatgctgcgggcgtgctgcttaacagcctgctccttcataagggcaaacgaaatgacattcacagcctgttcaatcagcagcgcgcgcaagtggtccgcctggtctaactcccccgtaatggctaaaaagcccgtctttttttcttttatatggataggaaacagcgtgtatgtcttttgatcccgtataacagaaaatgttaaggagaatgccggggattttgccggaaaatggccgggcaggcttgcctcaagcgaagcgaaagcagctcctgcacccggacaacgagcaaccacatcgaagtgctggtcaaggcattcacatgggcaatggatcattttcgacagttcatgaaggatcgggcgaatgccgtccccgcgcatcgccacatcagcaaaccgcttataggcttcaagtgccatcgttaactcacgtgcatgcttgtctacaattgcccgcaatgtcagatctaccacttctccaagcgtgagggaaagcggcaactcaatgaccggaaaagacaagcgttcagcaagttctaagacggtatccggtatcttccccaaaaatcgttttgtcttaatcccaagtgcggcacaacctttgtcagacatggcttgaatcagttccgccagctttttcgggtcgtctttaaaatggtacgcagttgtaatcagcatgacattgggttttaaataatggacaatatcgggcgcgtccatcatattcaccgtccggatttcatggttttgcccggatttccccgcaacaatggatatgccggcaagttccgggacttcgagcagatcctgcacattcatttgctttcccccgtttcctaaatattcaaattaagtattattgtatcataaattgttgattataaacaaaatggtcggaaaatttgtatgaaatacataatgaagtttcgaaaaacaccctttacactatagataggccatgttagaaaatcgtccattttatggaaaaggagttgacgattccaatgtccgtaaaccaattatctgagacaaaccaagtaagcgagatgatcgaatggctcgcctcctttggaaaaacaaaaacgggcggtgtcacaaggcgattgtatacaccggaatggcaagcggcacagcacgccctgaaagcaaaaatgaaggaaacagggcttgaaacgtattttgatagtgttgggaacttatatggcagagtccaaggtacggaaaaaagcggggcaattttaaccgggtcgcacattgatactgtcacagaaggcggaaaatatgatggcgcatacggtgtgatagccggttttatcgctgtgtcaaggctcctccggaaatacgggccgcccaaaaaaacaattgaaacggcgtcattgtgcgaggaagaaggcagcaggttccccatcactttctggggatcgaaaaatatttgcggcctgtatcattttcatgatgcggatggcatacaggatgaaaatggaattttactgtccgatgcgatgaagcgggcgggttttggaccaggaaaatacatctcccctgcccgcacggatatccgggcatttttggaactccatatcgagcaaggaatggtgctggaacaaaacaataagactatcggagtggccacgcatattgttgggcagcgccgctatacgattcggctaaaaggagaaagcaaccatgccggcacgacaccgatggccctgagaaaagacgcagttactgctgctgcccagttcatctcatacttaacaagaaaggcaaaagaaaccgatcccggtttagtggcaaccgttggccagattgacgtgaaaccgaatgtagccaatgtgattgctggtgaagtggcattcagcctggatattcgccatcacaggcaggaagtcatggaacactattgcaacgatgttttttcaacatttaagcgcaacgccaaaaagaagggaatccatatttcgattacacaatggctcgatacagcaccggtcgcgctggatccggcattggccgaaatagcgcgatccattgctaaatcccggcagattgcttttcaagatattgtgagcggcgccgggcatgacgcccagattttcggctcattttgcccgactttgctgctatttgtaccgagcaggaacggtatcagtcattcgccgagagaatatagcgctattcgcgatcttgaaaccggcattgatttattggaaagcgtattatacaagctggcttacacttaaatgatgcacaataaggagaagatgaaattggcatatgcagaattaacggcaccgaaacgaatcatcctgacacccggcccggttgaggtcgacccgcgtgtgttgcgggcaatgggcacaccgatcctcggtcaattcgatccggcatttacagccattatgaatgaagtaatggatatgctccgccaagtatttcagacaaaaaaccattgggcttacccggttgacggaacttcccgctccggattagaagctgtgctttgcagcattcttgaacccggagaccgtgtcatggtgcccatttatggcagattcggccatttatttgcagaaatttgcgaacggtacggtgctgaagtccacaccattgaatgtccgtggggagaagtattcgaaccgggccatgtcattgcggagatgaagaaaataaagccgaaagtgctggcaatggtgcacggtgaaacttccaccggcagaatgcagccccttgcagaaatcggaagggcatgccgcgaacaggacgttttgtttgttgtagatgcagtcgcatccatcggaggagcagatgtcaggacagatgaatggtatatcgatgcccttgttgccggaacgcaaaaatgtctgtcagtccctgccggcatggcgccgattacgtacaacagtcgtatagaaaaaatcgtgctggcacgcaaaaaagtggaacgcggcattgcaactgatgaggaccgtgcttatccaaggagcatgcgcccgatcacaagcaattactttgatctgggcatgctccaggattactggagcccgcgccggttgaaccaccacacagaggcaacgtccatgatctacgcgctacgagaaggattacggcttgtgttggatgaaggactgggagcacgtttttcacgccataaactgcatgaaaaagcgcttatcgaagggcttctggcaatgggactgtctttattcggcgaccctgtgcacaaactcccctgcgtcacttgcgtcaacataccggacggaaccgacggcgaatctgtccgccacatgcttcttgaggaattcggcattgaaatcgcttcttcttttggcccactgcacggaaaaatctggaggattggcacgatgggctacggctgtcgaaaagataatgtgctcgcattattaggcggccttgaagccgttctgattaggcatggcgtaaaagtgaaccgtggagaaggattgcaggccgcattggatgtatatcaatcagaaaaaacgaaatcgattgttttaaagtgaacgttctgctgtttttcggcatggacagcgaatgttaaaatacttgcttgagccgaacggggattgaccattgtgcggaaaaatatttcttttatccccctttttgaaacaggacgggtaaacctatacgcgggataagcacatactcgcagccaaaagggccgcttcttacgaaaaatgtatgtcactccttgggcggaaggccgcgtattttacgaaacgcttcccgagaatagtggctgaatgccgcgatcaaacagccaactttatcatcccttgcaaaaataaaagctcccatcagccgttttgcgattttgagacaactttttttgttttttaagtgtcgtgcaatatttaccagccgtcttttcttcgggacagacacaattccgcctccttgttcatatgtttgaactatataggctcaagcctaatggaggtggaaggatgtcggggatcttaacagcggtaagctatatgatgaaagagcttgtttttttggtttcctatgtgaaaaacaatgcttttccacaacctctttcggcaagcgaagaacggaaatatttgaagcggatggcggaaggcgacgcggatgcccggaatattttaatcgaacataacctgcggcttgtagcgcacatcgtcaaaaaatttgaaaataccggtgaagatacagaagaccttatctcgatcggaacaattggcctcatcaaagcaattgagagctattcggaagggaaggggacaaaacttgccacttatgcagcaaggtgtatagaaaacgaaatcctcatgcatttaagagctttaaagaaaacaaaaaaagatgtttcgctgcatgacccgatcggccaagataaggaaggaaatgaaatttcgttaattgatgttctccagtctgaagcggaagacgtatttgacacgatccagctgaatatggagctggaaaaagtgaaacaattctttgacatattggatgaacgcgaaaaacaggtgatcatcggcagattcggcctgaatttaaaaaaggaaaaaacacagcgcgaaattgcgaaggagctcggcatttcaagaagctacgtatcccgtattgaaaagcgggccctcatgaaaatgttccacgaattttaccggcttgagaaagaaaaaagaaaggaacaaaacggcgaataatgaaaaaggcacattgcaaaatttgcagtgcgcctttttcatattttttttaacttaaacggcgccaccatcaggaccgacaacagcaccatccacacaaacaaccagaagtgggtgacataaggaacggcaaaaaaaccggccgttacacataagcctgccacggggatcggaagcccgtaaaaaaatccctcttgcttgctgatattaaaccgggcgagccggatcatcccgcaaagcatataaaaaatggcggccaacatacccggaaccccgtacaggcaaaacagcgctgtatggatcagcatggcaggcgcggcgccaaacgaaagcaaatcgcaaagggaatcaagctgcttgccaagcgcggattccatttttaacttcctggccagtttcccgtcatagcggtcgaacaatacagcggcaaagatcaaggctgcggaaaccgccggctgatgattgccgcaataaaaaagcgctgcagcaccgcagcatccgtttgccactgtcaatccattggcggcttgcgattttataaaattcaagatagcatcataccaatgatcaaagtccacccccgcaaacctcccaactgccatttatttatatatatattcaagaaaaaaaggattgatcacacaaaaaaagccacatatcaagcaaaagtggctaggacgttgctttgattttatgggtcagggaccggcgttcaatctctttttcaatcagcttcacaaactcggcacttaatttcagctcttttgctttataataggactcgatcaatagttcatcagataacttatacatctgtaccacctccgaaaatgttgttcttttttttaagcatcctgcgtatcataaagagagagtatttgtattcttactttaccaaatttagccttgcggaacaagcgttcttttatccacagtaaaatgtttatatcttgtgggtaaattgtttataaacgtgagaaggcctggtgttactttgtgcaaaatgtgtataagaatatccacagcaacggagaatgtagaaatctgtcgaaaagttttgtgcttttaaagggacaaaaaaaagactgcgcagtggcagccttttttcttttgccggtacaaaaggaaaatccgggcaaaaggcgtatttatgaggtaaaccgcttgcttccatcggggttttgcatgctggatccggcttcatgtgccgggcatgcttattgaattgccgtaagttttgttttccggtttaaactttgttgtccggcgccaggccgcaaacatatgtccctttttcaatttggatggtagcgtgttcgatcccgaatttgtcatgcagttctttttccagtttttcaagcagcaggtcgttgtcttcaatttgcgaacggacaatatggaccgtcaatatcgtttctgtcgtgctcattccccagatatgcaaatcatggacgttgagcacggtcggaatttgttctaaataggttttaatcgcatcagcatcaacgcctgcaggcaccgcatcaagcgaaaggtcggctgcttcccgcaacaggccccatgtccccgcaaaaatcacaatcgcaataatgatgcttgtaaccgggtcgacccactcccagcctgtaaacaggataatcgcacctgcgatgacaacgccgagagagacaagcgcatcggcagccatatgcagaaaagcgccgcggatgttgaggtccgtttttcttcctgacataaacagtaaagcggtaatggtattaataacgatcccgatcacggcaacgatcatgaccgttttgcctgcgacaggttccggatgggcaaaacgctggattgccccgagaaaaatcgcgccgatcgcaatcagcaaaataatcgcatttaaaagcgcagccatcacggatgattttttatagccgtatgtgcgcttttttgtcggcaattttttgccaagccagacagcggcccaagcaatgatgagcccgagcacatcgctcagattatggcctgcatccgccaacagcgaaagggaatcggaaaagaaaccgtaaatggcttcaaccgcaacaaaaagaatattcagcccgatgccggcggcgaaagcttttccgtattgtgccggttcatggtgatggtgttggtgtccatggtcgtgtgacattttattggctccttttacacatgctgtccaaaagccgggaaacaggcttttggacggacgtcagttgttaagttcattatatgcgtatctctaaagtttgcaaagaaacttttacaagaaagtaaactttatgttcattttcgcccatttccggcttgaaatgctacaataagacctataaagacagaaaggaagagaaggaatgccggaatatgaacatgttgaggaacatttccaggcatctgacaccgtccgtgatattgtgattggcatgtcagacgggctgactgtgccgtttgcactcgcagcaggattatccggtgcagtggattcgccggtgctcgttctcgcggccggcgcggcggaaattgcggccggttccattgccatggggcttggcggatatctggcagcaaaatcggatgccgagcattattatagcgaattaaaaagggaataccgggaagtagaagaggtaccggaacgggaaaaagacgaagtccgggatgtatttaaggcatatgagctgaaaccggaacaaatcgaagcaatcgtcgataaaatggcggaaaaccctgataaatgggtggattttatgatgaaattcgagctggggcttgagaagccggaaaaagggcggagcttaaaaagtgcgttaacgattgccttgtcttatattgtgggcgggctgatcccgctttccccttacttttttgtcacccgggcatcacaggccttgcttgtttccgtcctggtgacgctcgttgttctgtttattttcggggcggtgaaagggcggtttaccggttccaatgtgtggaaaagcgggcttgaaacggttgtgattggtggtttggccgctgccgctgcgtttgggctggcaaggcttttgacaaaataaaacgcactttaagaacggcacggggaactcttttcacgaaaaaacagtggggggagcccatgccgcaatggactggagggagctgtatgttatatatttgggtcggggttgccggtattttcggtgccttggcacgctattatttcggcatatggatcggcatgtacacgcatgccgtttttccatacccgacacttgcgatcaatctggccggctgttttttgcttggctggcttacgatgcatatatttcagtctaaaaagattcatccttatgttgtaaccgcacttggcaccgggtttgtcggttccttcaccacattttcgactttcagtgtggaaacggtgcagcttatccggcaatcgcatgcgtttgccgcgatgttgtatgttttctgcagtttatttggcggcttgttcatgtcatgggccggctttaaacttggcggaatactgcattcgcgggctaaaggcagcgtcggttcagatacagcgtaaataaaggagacggattcatggttttaaacggcatctttatcgcaattggcgcctttttcggggcggtttcccgattttctctttcgcggtggatcaaccgggcctttccggcaaaattcccgctggccacatttttcattaacctttcgggctcatttatgctcggccttctgttcggtgctggtgccgggagttcgtggcgcctgcttctcgggaccggctttttgggtgcctttacaactttctccacttttaaacttgagaatattcagctgcaagcagacaaaaaatatcatattcttgtcccgtaccttgtgttgagctatctgttcggcattgccctggcattttcaggcatcctgctcggaaaatattttacatgaagcatgaaacttttgggcaggcactccgtatcttaatgatagacggccggtacatgttttctttttatttgccgagcctggtatttcaatgctcttgacagggtattggatttataagcataaatgaggaggattgtatatgaagaagtggatgccatggctgattgtggccgccatattggtggttctgatcgtcagcgtttttacaagttataacagcttggtgaatgcggaagaaaatgtaaatcaatcttattcgcaaattcaaaaccagctgcaacggcggacggatttgatcccgaatcttgtgaacaccgtcaagggctatgcttcccacgaaaaagcggtgatagatgacgtctcgaaagcccgcgcacaattggccggggcgaaaacacccggagatcaggcagcggcaaacgaccgcctggacagtgcgttgagccggctgttggtggtggttgaaaaatatccggatttaaaagcaaaccaacaatacacgcagctgatggatgagctcgccggcacggaaaaccgccttgctggcgcgccaggattacaatagcgccgttgccacgtataacaaaaagataaaaagaatgcctggcgcactgattgccggtctctttggttttaaggaaaaggaatattttaaagcggatgaaagtgcaaagaaaaccccgaaagttgattttgggaacagcagtgatcagtgatgaaaaaggccgcgcttattacagccgtttttctcacctttctttttgccgtgtgctcggccgtttctggtgtgcacgctgcgacggacattccggaaccggttggagacatctatgtgcaggattttgccggtgtgctgacagacagccaaaaacaggagctcgtttcactcggcaagcagctggatgagcaaacaaaagcgcaagtcgcggttttaactgtgaacacgatcgggaaagacacaaccattgaagcgtacgccaataaagctttccgccagtacgggctcggcaataaatccatgaacaacggggtattgctcgtactggcagtaaaagacaggaaaatcagaattgaagtcgggtacggcctggagggagcgcttccggacggaaaagtagggcggatccttgatcaatatgccataccgtatttgaaagaaagcaagcccgatgcggcggtgatcaatacgtataaggaacttgccaccgaaacggcgaaagagtacaatgtgaatcttcaggcccatccaaaggcgtatgagcagccctcttccagccaggcttcccccttatcgttctggaaacagattttaatcgggcttgggatccttatcctgattttcattgatttcaagtttctcggcggaaccatgacgtattttctgctgaatatcctgatgatgttctttcgcggcggcggtggcggcggaagcggtgggggcggcagcaaaggcggcggcggttcttccggaggcggcggtgcaagccggggatggtaacgccaaacacagcaaaaggttcccctttttaaacggccgggaagcccgctttaaacagcttggcaaaagccccgacagcccttgtaaaaataaaaacggtaaaagcagcaggataaagcaccctgctgctttctttgcgtggctgttgagatttcgggatgtccagttcgttccggccgcaatcgagcaggctgtacagctaatagatcgttgcaacctgtttggatgcccatctgatatcagccgcatactggtttgcggcagaacggttctttgcatttgcaataccggccgggttccacctcgttttataaaacgtcttctgtcctcttttcaattaatggtgttctagcgtttgcttctatttcatcgaaaaaaagaatagaaatgatagaaaagcactttaatacccgaaaaggagctgaagtggttgaagaaaatcgtgttcctggctgccaccgtgcttttggccacagccattttgcttacggccttaaaaaaaccggacgatcccgataaaaataaaataacaggggagaagcggcaaaccgccgtgaaagcacaaccgctatccggcagcgcagaagcaaaagaaggggaaaaggcgccggattttgcactgacaaatctatcagggcaaacggtcaaactgtctgattttaaagggagaacggtaatcctgaatttttgggcttcctggtgcccgccgtgtaaagcagagatgccggatatgcagcgtttctatgaaaaaaacccggatgtcgcggtgcttgctgtgaatttaacaaatacagaaacgaacgagaatgcgccgcttgactttgtgaagaaaaacggcctcacctttcaaattctgtttgatatggacggctccgtcggcaccctttacagaacggttaccattccgacgacttacttcattaatgcagaagggaccatcacccgtaaattcattggcccgatggatgagaaaacgatggccggatttgtggcagagatgcaaaagggggaaaaagggaaggcggaatagagcaaagattttttaagaaaaaagtggtacagttacaagtaagggaatgtaaaaaggaaaggtgctgactatgatgatgtacggtggctatggcatgatgagcgtattcggcttaattggcatgattgcccagctcgtcatctttgtgctcgtgatttttttgattgtagcgggcatcaaaaaagtaagtgaattccggccgcatcaaagggaggacagaagcctcgacatattgcgggaacggtatgcaaaaggggaaatcacagaagaagaatttaaaaaaatgaagaaagatttaatggattaagggagtatccggcttcttttttatacaaaaaagcgggggcttgtattccaagcctccgttttatattactggatttgaatccgttttccggacggaccttctgttgttttcttcgggatatgaattttcaggacaccgttatcaagggtggcactgatttcgtcttctttaatattatctacataaaacttccggacgaattcgccatagcggcgttcctgccggataaatttgtgtttttcatctttgctttcttccgtttggtcgcgttttgcacggatggtcagctcattattgtggacatcaatggtaatgtcctcttttgagaagcccggcagttcggcctccacaagataagcatcttctttttccgtaatgtcagtacggaacgagtttgcgttcgcaaaaggcgccaacgcattcggatcaaacatctcgttgaaggtcttcatcatacgttcgaaaacatcgtcgtttcttctaaacggcattaaatcaaacatattcaatccctcctttacactattattataccccactgcgaaaaagatgaaaacaaagatgccaatgcacaaaagatgttcacaaaatcgtcaatccataacaatggatttccggtgttaaaaaacattacaatagtactgaacataaaaagaaaaagtaggggtaagatgaacaagacaaagttatgggctttgattctaatcgtggccattatagggattggcggtgttttcttttataatggttatgtgaaaaaaagcacaaatcataaagcggcacagcatccggatctgcccattccggccgttttaaaagatacgaacccggatcccaacgcggcagattttactttaaccgcacagcaggggaagaaggcatttatttccgggaaaacagcggcaacgtacgggtataacggcgactatttggggccggtcatccggttgaaaacgggcgaaaaagtaaatatcaccgtaaaaaataaattgccggaagcaacgacggtccattggcacggcctccttgtccccggttcggctgacggcggcccgcattctgccatccagccgggcaaaacatggaaagcaaagtttacggtgagccagcaggctgccacgctctggtaccatccccatccgatgggaaaaacgggcgaacaggtatacaaaggtctggccggtctcatttatgtcgatgacaaacatgcggaaagcctcgatattccgaaagactacggcaaaaatgattttccacttgtgctgcaggaccgccgctttaacaaaaacggccagctcgtgtacaaattaaatatgactgatgaaatgtacggcttccagggcacaaccgaactggtaaacggcgcggttaagccgcagttaacggtcaggcgcggcctcgtccgtttccggattttaaacggggcaaacggcaggacgtacaatcttcatctgagcggcaacaagacatttgcgcaaattgcatccgacgggggattcctcaagacgcctgtgcaaatgaaaaaactaacgctttcccccggggaacgtgcggaaattctggttgatttttcaaagatgaaaaacggcagtacgctccggctccaaaacgggaaagaaacgctcatgtattttaaagcaaaaggaaaggctaaaaagacgtacaaagttccgcaaaacctggctgtgattgaaaaaataccggtgcaggaagcggtgaaaacgcggaaatttgtcatgtccggaatgggcccaaacgtccgcattaacggcaagcaaatgaaaatggaccggatcgatgagaccgttcacttaaacacggttgaaatatgggagatccagaatcaatcgacttccatgggcacgaaaaaaatggtgcatccgttccatattcacggtgtccagtttcaaattttgagcatcaacggcaaaacgccgcctgccaatgaacagggctggaaagataccgtgcttgtcaatccgggcgataccgtgaaagtcatcatgcggtttccgtttaaagggatttacatgtaccactgccatatcctcgaacatgaagacttgggcatgatggggcagtatgaagtgaaataaccgaaaaagggcgggaaatgtgtcccgctcttttttgatatgatgagaagccgcaggaaactgcatagacaggttggaaaaacgtaagaaagaaaggcggacaagcgatattcgattatttgattaggaatccgcatctctgcaagaaacatatatgctggagcgcctgcacagtggggaaacccgtggatgctttctgtgcgggtttgatttttattgaaaacagcattcctgccttttacatctccccatctcgctcgaacaggttactcgttttcctgtcctgccaagtgaagggcgagggaaaacaatgcaatgccgtccgcttttttcgggtcaatgccggttacatcgcggatctgtttcagcctgtaatggagcgtattgatatgcacatgcagggcagcggccgtttttttcagggacaggtcatgagcgagaaaggcctgcaatgtttcaagcaggcaagcatggctatacagttttccgatcgttctttgtacaaacgcattccgtgtatcgtcctgcacttcctggaccaaaagatcaagcagcaagtcttcgtaaaagacgatgctgcccgttttctcagcggatgccaaggctttttgcgcttctttaaatgattggcggatgactgacgtgccggctgttttcccggcaccaaccgcacacggggtgccgtatttccgcacaaattcatgctggacggcttcgaaacggctccggagaccgcagccggtaaacggtgtttctgcactaatcagcagcagaaaaagcccgggtccccagcggacaatcacatcccggttgttttcaaattcggactggagcaagcgaaaagcatctgtttccaccgcttgcgggatttccgcttttaataagcagcaaatatgcggattctgcactggaatcccgagcatcattccgcgttcggcaaaatgctggtcataggcttcaagattcacccattcgtaaaagtaagcctcaagcccccttgttttcgactgaatttgttctgtccggacggtttcctggatgataagttccgtcagtcgccggatcaattccgcataatgttcgactttttccgggtttcccgtcaccccgatcactccgatggtccggccttcaaaccggatcggcatgttgatccccgtccgcacgcctttcatctgcgccaccattttttcatcaatgtacagcttccggctcgtttgaaaaactttgcgcgcccccctatggacatgcccgatccgttctttttgcgtcgaggcaatgatcaccccgctttcatctacaacgatgatatcctcatccatgaccgactgcacttcgtttacgatattttcagcaagttttgggtataaaagcattttgacccacctttgtataaaaatctaaaaaacaagcaaaagaaaccggtaaactttgtatctttctctatatcattctccatgatttagatttatcataaaaagaaacagaaaacaatctattgacggtatcaatgatcaaaaagaacgggggaatgtttcatgatcgaaaccggggccaaagaaaaactgattcaagtcgtcggccgggaaaattacgacgacacgcaggcgggccggcttgtatattcatatgacgccagcccgcaattccaggtgatgccggatgcggttgtcgcgccgcgcaataaagcagaagtgcaggcggttgtgaagctttgcaatgaataccggattccggtcgtcccgcgcggatccggctccaacctttgcgccggcacatgcccggtggaaggggggattgtgctccttttcaagcatatgaaccgcatcctcgagattgacgaagagaatctgacggtgacggttgagcccggtgtgatcacgctcgatatgatcaaagcggtggaagcaaaggggctgttttacccgccggacccgagttcgatgaagatttcgaccattggtggcaatatcaacgaaaattccggtgggttgcgcggattgaaatacggggtgacccgcgattatgtgctggcgcttgaagccgtgcttgcaaatggcgaggtcatccgcaccggcggaaaactggcaaaagatgtagccggctacgatttgacgcggcttttggtcggttcggaagggacgctcgctgtcattacggaagcgacattgaaacttgtgccgatgccggaagcgaaaaagacgatgcttgcgctttaccaggatattgaagcgtgcgcacaaacggtctccgatattattgcgaaccggatcatcccggcaacgcttgaatttttggaccagccgacactgcaggcagtcgaagcttttgcgcatatcgggctgccgactaatgtcaaggcagtgcttttgatcgagcaggacggcccgcaggaagtggtggaacgcgacattgaaaagattgcggacatttgccgcaagcagcatgcagtcgatgtaaaggtggcagcttccccggagcatgcggaagcgctcatgacggcaagacggagtgcattaagcgcactcgcccgtctgaagccgacaacaattttggaagatgcgaccgtgccgcgttctgaagtcgcaaagatggtagtggcgatcaatgaaatcgctgaaaaatacgggcttcatatcggaacattcggccatgcgggggacgggaatctgcacccgacctgtcttgctgatatccgcgatcaggacgaaatggagcgggttgaaaaagcgtttgcggaaatttttcaaaaagcgattgaactgggcggcacgattaccggcgaacatggcgtcgggatggctaaagcgccgtaccttgaatggaaactcgggaaaccgggcattagcgtcatgaatgcgatcaaaaatgcgctggacccgaaccatattttaaatcccggcaaagtctttgccaaagaaacggatcgagtggtgatggaaaaatgataacacaagaacagcaaaaagaaatccagcagaaattcagggatagaatggacgaagaccagcttttaaactgcatgcgctgcggcttttgcttaccgtcttgcccgacctatattgaatcggggttcaaagaatcgcactcgccgcgcggccggattgcattaatgaaagccgttgtggacggcgttatcgaaccggatgaagatgtggagcgctctttggacctgtgcctcggttgccgggcttgcgaagcggtatgcccgcccggcgtccaatacgggcatcttttggaagaagcgcgcgatattatccagcaatcgaagaaaaagaagcagtctctgccggtaaaagtgatccgaaaagcggtctttgaagaattgtttccccaccagaaccggatgcgtgctttaacaggcctgatcggcttttaccagcgaagcggcttgcaaaaagcggcgcatgcgacaggcgctttaaaacttttgccaaaaaatctatcgtctatggaaaaagtgctgccaaacatcccaaaatggaaggaaatgaaacagcgcccggaacatctgatgccaaaagcagaagtaaaaaaacgcgttgccttttttaccggctgcctgatggatacgatgttcatggagaccaatgatgcgacaatgaaactattgcagcttgctggctgtgagattgtcattccgcaggaccaggtatgctgcggggcgctgcacggccacggtggcgaaaaagagatggcaaaagaccttgcccgccgcaatatcaaggcttttgaagatttgcacgccgattatattattacgaatgccggtggttgcggcgcctatttaatcgattatggccatttgttaaaagacgatccggaatgggcggaacgggccgcggcattttcaagcaaaataaaagatatctctgcgatcctcgtagagctgggcttccataaacgaaaactcagcctcccggaacaagtggtgacgtaccaggattcatgccatttgcgcaatgtgatgaagacctcttctgccccgcgcctgctccttgacgcgatcgaaaatgtggaattccgggaaatgaaggaagcggaccattgctgcgggtcggccggcatttacaatattgtcgagtcggagatgtccatgcaaattttggatcataaaatggaacacgcaaaagcaacacatgccacaaccattgtgaccgccaatccgggctgcctgctgcaaatgaaactcgggatcgaacgggctggtttaagcggaaaagtccgcgctgtccatatcgccgacttgctgatcgaagcgattggggaaaaagtgccggtataaagcgcaaagttttttagcggaccgggcatagcgaccttgcgatttacccatggagtcgaaccgaactgttagaaagcaatcaaaaccgctgagcgtaccctgcccggcggtttttcctgtttttccggctttcggggaactgggtattgctatcagttgaatcttttgcaaaaattgttatgataaaagaaacttgaatgaagcatattcgggacaatatacgcataaacgggcggataagcttgcatcttgtggacagaacggtaaaatgaatggagtgtcacggattgatcttgaaaaattttttgccggatcggcaagtgaaatcggtgttgtcaatcaggccggaagaattaaaaaagcatggcattagagccatcatcaccgatttggacaatacattggtcgaatgggacaggccgagtgcgccgccaaaactggtccaatggttccaagacatgcaggaacatcatatcaaaatcacgattgtttccaataataatgaaatgagggtcaaaacattcgcggacccgcttggcatcccgtttcttttcagagcgagaaaaccgcttggcaaagcgtttcgtaaggcgcttgccatcatgaacgtgaaaaaggaagaaactgtcgtgatcggcgaccagcttttgaccgatgtgctcggtggcaatagaagcggtttttatacgattctcgtcgttccggttgcgcaatcagacggatttgcgacaaaactcaaccggatgattgaacgccggattatgggttggttcaggaaaaaaggttatttgacttgggaggattgaatttggaaaaacaagctgtccattgtatcggctgcggggcactcatccagacggaagatccggatgaggcaggttacgcgccaaaatctgcgctggaaaaagagcaggtcatttgccagcgctgtttcagattgaaacattacaatgaagtgcaggacgtgccgcttacagacgatgattttttaaaaattttaaaccggctcgggcaagtggatgcgcttgttgtaaaaattgtcgatatttttgatttcaacgggtcctggctgccgggatttcaccgtttcgcgggcaaaaacccggttcttttaatcggcaataaagaggatctcctgccaaaatcggtgaaaagagcgaaaatggccaactggatgaagcagcaggcgaaagaactcgggctccgtccggttgatgtgctgcttgtgagcgcagcaaaggggcacggcatggatgaagcgatggttgccatcgaacagtaccggaacgggaaagatgtgtatgttgccggctgtacgaatgttgggaaatccacttttatcaatcgcattatacggcaggcaacaggggaaaaagatgtcatcactacatcttattttccggggacgacgctggatatgatcggcatcccgcttgatgacgggacctctctttatgacacgccggggatcatcaaccaccaccagatggcgcatttcgtcgggaagaacgaattaaaggtgattacgccgaaaaaagaaatcaagccgaccgtattccagctgaacgagcagcagacgctgtttttcggcggtcttgcacggcttgattatataaagggcggcagacgttcatttgtctgctatgtttcaaatgctttaaagattcaccgtacaaaacttgaaaatgcggatgatttgtatgcgcgccagctcggggaactgctccagccgccgggaaaagcggaagccgcggatttcccggcgctcgttcgccatgaattttccattaaagaaggaaagacggatattgttttttccgggcttggctgggtgacggtcaacgaaccgggcgccgttgtcgcggcctatgtgccaaagggtgttcaggtcatgctgcgccagtcgttgatctgaaaaaggttctgtttttaacggggagtgagaaatgtgcgcgatttatatggggtgatcggtgacccgattgcccattcgctgtcgcctgcgatgcacaatgaagcattccgggcactcgggattgatgcagactatcatgctttccatgtcacgccggaaaatctggaagccgccgtaaacggcatgaaagcaatcggcgtggccggatttaatgtgaccattccgcataagcaggcgatcatgccctatttggatgagattgacttgcttgcggaaacgatcggtgcggtgaataccgttgtccgcactccacacggatgggccgggtataatacagacggcccggggtttatgcaggcgctgaaagaagaaagcggtcgggtgatttccggggaaaaagtgcttgtcatcggcgcgggcggtgcggcaagagcgatttattatacgctatgccgggaaggggcagtaaccgttgatctgtgcaaccgcacggtaaaaaaagcggaagaaatgcgggacgaaagcccttttccgtgcccgtcaaaggtgcttacgcttaaagaagcggaagaacagctgggagaatatacgctgattgtgcagacgacatcgatcggcatgcatccaaatacagacgcacagccgctttccgtccgcaatttaaatccagatgcgtttgtatctgatattatatacaatccgtttgaaacgaaatttttaaacgaagcaaaaaaacgcggcgcccgggtgcaaaacggcctcggcatgtttatttaccagggggctattgcgtttgaaaaatggaccggtgtgaagccggataccaggaaaatgaaaaacgtcgttgaaagcattctaggaggaaactcatgttaacaggtaaacaaaaacgttttttgcgggcaaaagcccaccatttgagcccgatttttcaggtcggaaaaggcggggtcaatgaaaatatggtcaaacaggtgcaggaggcgcttgaagcgcgggaactgatcaaaatcagcgtcctgcaaaactgcgatgaagataaagatactgttgccgcagcgcttgcagaaggggcgcgtgcggaactcgtgcaaatcatcggcaatacgattgtcctttataaagaatcgaaaaaccataaagagattgttttgccttaagggtgggcggcatgaaaagagtgggtattttaggggggacgttcgaccctccgcatattggtcatttgattatcgcgaacgaaattttgcaggatctgaaacttgacgaagtccgttttatgccaaaccaggacccgccccataaagaaaaaacggccggcatcactggccatgaccgaatcaaaatgctcacgcttgccatttcggggcagccggcattttcgattgagggaatagagatggagaggcccggccgctcctacacctatgacacaatggtgctgcttaaaaagcgggaacctgatacggacttttattttatcattggcgcggatatgatcgaatacttgccgaaatggcggaatatcgaccaactcgttcggctcgtccgctttgtcggcgtcaaccggccggcatattcgcaccagaccaagtatcctgtccaatttgttgaaattccggaaattcatatttcctcgtcactgatccgtgaacgtctgcaaaaaaatcggtcggtaaaatatttaattccggatgcagtgtgggaatatataaaggagcatcatttatatggaacgtgagaaagcattggaacttgtcaaagcacagctgacggagcgccgttacatccatacgctcggtgttgctgaaagcgccgtccggctggcgaaaaaatatcatgctgatcagaaaaaagccgaacttgcggcgatttttcatgattatgcaaaattccgcccgaaagaggaaatgaaacaaatcatcctcgaccagaaaatggacgaacggctgctttcttttcatcatgaattatggcatgcccctgttggcgcttatttggtggaaaaagaagccggcgtcacggactgggaagtgctcgatgccatcaagtaccatacatcaggcagggctggaatggcgttgcttgaaaaaattgtatatctggctgattatattgaacccggccggaattttccgggtgtcgaagaagcaaggcggcttgcggccaaagatctcgatgaagcagtattgtatgcagccgggcataccattacatttttaattggccggaatcagcccgtttttccggatacgattgcgttatacaatgatttagtgatgaagaaagaaggggagtaaatggacaatcagacgttattaaaaacagtcgtaaaagcttgcgatgataaacgtgcggaagacatcgtggtcctcgatatgcgcgggatttcattgattgcggattatttcctgatctgcaatgggaattccgataaacaaattcaggcgatcgcccgtgaagtgaaagaaaaagcggaagaagcaggaactgcggtcaggcgcatggaagggtttgaagagggaaaatgggtgctgattgaccttggggatattgtcgcccatatttttaaccgtgatgaacggaattactataatttggaaaggctttggggagacgcaccgactgttagtgcggagagcgtcttgcaatgagctacgaaaatttcgcctacgtatatgatgcgttgatggaagatgccccctatccgcaatggctgcagtgggtgaagcagcaaagggagcggcatggtgtcaaaggaaggcgcatgctcgatcttgcctgcggtaccggtgaactgtcactgctgcttgcacgggaaggttttgaagtaacgggcgttgatttatcggaagacatgcttacagtcgcgagcggaaaagcactggctgaaggggcacacctcactttcctgcagcaggatatgcgcgcgctttgcggcctgcatgattttgatatggtcacgattttttgtgattctctgaactatttggaaacggaaacagaggtcaaagaaacgttccggcatgtgcatgcagccctgaaggccgggggaatgtttttgtttgacgtgcattccgtttataaaacagatgtgttattccctcatcacacttttgccgataacggggatgaggtttcctatatctggaactgctttccgggtgagcgcccgcatgccgttgaacatgatctcagttttttcgtatatgatgagaaatccggcttgtatgaacgttttgatgaattacataaacagcggacgtttccggttgctgattatgaaaactggcttacggaatcgggcttccatgttatgccgcccgctgctgattttacagaagaagcgcccggcccaaaaagtgaaaggatattttttacgtgcatcaaacgataaaagcattctgcctacgcagaatgctttttttgaaaaaaatttaaaaaagaagcaggaataaacagaaagatgtcgaaatatcatggtgtgccgaattgcccggccaccgcgtccgtatcttccttaaatttctcatgcgtcgcttcaaacagtttttcgaataagccatccgtccctttttcaagcacctttaatccttcgccggtgataccgccttttaccgtcacttttttctgcagggcaggtagcgtataaatttgctgcttcagcagttcccccaggccgatcaacatctcagccgttaatatgcaagcggtgtcgctgtcaatctttgttttgttgacggctccttctatcattttttgtgccaaaaaactgaaaaaagcaggaccgcagctgaccaaatccgatgccactctcgtgatttgctggtcaacttcaaccggggtggatattttggagaacaatgtttttaattttccctgccactcgcttgtgcactggctgccaaatgtcagcaacaccgcaccggcagctgccctgtttgtaatgctcgggatggctcttgcgcacgagcagggaaccattgtggcgagctgcccgactgtaaccgggcttgtaatgctgacaaggcactgatcattccggaaggcgcccccagccttctctagaatgccgtgcatctcaagcggttttacacacagcaaaattaagtcgctctccaaaatagtattttctatatttttaacctgcatcccgggatacttgtttgcaagttttgcggctttttcaggtgtgcgatttgtgatccggaattgtgcaggcgtaacggcttttgtttctatcaaagcttcaattaacatgctacccatatttcccgttccgatcacgccaatgttcatgctggcttcccctcctcaagccgccgatctttcagcgtccggtacaatatatgtacaaattcaggcgattatgtatccaaaaacaaaatggaaaaaaagaggtgaaggtctttgaaaacgttgtttctcaaataccgctggcatgcagctgcggctgtggcagccattacgattgcaatcttttactattttagccaaaatggaggtatggacactgcttccggggcttaccagcaacccgaaacggccgtgcagtccggacagcctgcggagggcgggacagatgtgcaaaatcaaaacgggacccaaaataccgcacaaacgcaagccccggcccaaacgcagaacgctgccgaagtttacgtggatgtaaaaggcgcggtgaagcatcccggcatctacaaagcagaagcagatgaccgggtctatgacctcattcaggaagcagggggctttaatgaaaacgccgaccggaatcaggtcaatctcgcgcagaaagtaaaagatgaaatggtgattgaggtgccgaaaaaaggcgaaaaagcggcttctgcccaaactgccacggcggctgccggaatttctgcgcccgcttcctcttcttccgggacggcggcaagcggtgaagcggccgcacaggtcaatatcaatacggccgaccagacccagcttgaaacgcttccgggcatcgggccgtcaaaagctgcggccattatcgaataccgggagaaaaacggcccttttcaaaaaccggaagatttgaaaaatgtgtcggggattggggaccagacttttgcgaaaatcgaaaattccatcactttacagtaatcacatgagcagaaaggaagagaaaaatggaccggatttcctggaaccagtattttttggcgcaaagccatttattatcctggcggagcacttgttcaaggcttgcggttggggcgacaatcgtcagggataaaagaattatcgcaggcggctacaacggatcgatcgcgggggacgaacactgtattgacaaaggctgctacgtgattgatggacattgcgtgcggaccatccatgctgaaatgaatgcgattttgcaatgtgcaaaattcggggtggcaacaaacggcgcggatctttatgtgactcattacccgtgcctgcactgtacgaaagcaattattcaggcaggaattcaaaacgtgtactatgcccaagattaccgggtacatccgtatgcaaaggagctttttgaaaaagcgggggtgcatgtcgaacatgtcccgttccatccggaaacgctcgatatccgggcgaaagaaaaagccaaactggtggagaaattattcatgattgcaaaggaccacggggcggaagcggcagaactggaggaattgcagcaaatggcggcggcattatttgcaggcacttatcaagaaacggaaacgggatccgttccgaaagcgtaacacggtgatggtgtgaaaggcaactggctgttcgccgcgctcgccacgttaagcggcatcctgattggccttcacgcgccgctgcttctggttctttcggcccatttggtttggatccggattttcctggcccgaaaccggcctttgctccttttgtccgctgttttttacgggttggggtttttgagcggtacctttcagacagttgcgtatgatacaaagtttcatgccggcagtgcccggacgcccgtccgcttcagcgattatccgcgtatcgacgggaacgcgatcaagggaaaggcggaaaccgggaaagaaacgtttatgttaacgtattacgctgggaacgaagcagaactggaatctttgaaacaaatcttatcccccggaacggtttgcatggctcaaggggaactggaagcccctgagccaaaccgcaacccgtctacatttaactaccgcacctatttggctcatcagcatatccgctggattttaaaagcggaccggctttccgcgtgcaacagcccgccccagcatctgcacggtttcttgaaaaaaatccgccaccacttcctgcttcaaattcaaaaaacatttccggaaaaatccgtaccgtatgcagaagcgcttttgtttggcgagcaaacagactttgatgacgatgtttaccagctgtaccagcggcttggcgtcgtccatctgcttgccatttccgggcttcacgtgcagctcgttgccgggttttgctactatttgttcatccggctcgggatgacaagggaacgtgccgccgtttgtttactgggggtgatgccggtttatgcggtattatgcggcatgaacccgccagttgtccggtcggcggcgatgacgatgctgcttgtgctggctgggcaaaaaaaactgccaatcgggccgctcgatgctttgtccatctgcttcattttgtatgggttaaaaaatgcaaatattgtgtataatatcggattccagctctcttttgccgtttgcgccgcactgcttctttcagggcctcttttagagcggttccggggcccgttgcaaaaagggctcgcaatctcgttcatttcccagcttgcggccctccccatcctttcttattcattttacgcgttttctattgtggggcttgttgctaatcttttttatgtgccgctttatacgtatgttttgctcccgcttgctgcgcttgcctttgtttcagaatgggcgccgccgctgttttccatctttgccacgtgttttgacgggcttgtaacgctgtcggaaaaaacgggggaagcgttcgacggccgctggtccacgctcgttaccgggaggccgccatactggggattgatcctgatgacaggtgtgggattttatggtttggtggcgatggaaaacggcaagaaaacgatccgggctgtcctgccacttttttctgtgcttttgctcctccttgcggcaaacagatatccgcttttcggtaaaatcacctttattgacgtcgggcagggggacagtattttaatccggctgccgctttcaagggggacgtatttgattgacacaggagggaccgtccagtttccggaaccggcatggaaaaaaagagagcatccgtttgaaaccggcaaagatattgtggtgccatttctaaaaagccaggggattacaacgattgataagctgattttaacgcacagcgacgaggaccatattggcggcgcaacggcggtgatcacgtctctccgcgtcaaagaaatcgatatctcgccccattcatgggaaaaaccgctgatgcagaaggtgctcgcttgtgcccgacagaaaaaaatcccggtatatgaaatgaaaagtgggaacggatggcaaaacaaatcgggcgtatttcaatatctttcgccgtttgacgaaacgtatgaggggaataatgactcgcttgtcctttatgcgaaaacagggggaaagacgtggctgtttaccggagaccttgagcaggaaggagaagaaaaactcgtggcggcttatccggatatccacattgacgtactaaaagccgggcatcacggcagcaaaacttcgacaagcgaaacgctcatcttaaggtatcatccgcggatcgccgtcatctctgtcggaaagcataaccgtttcgggcatccctctccggaagtggtcaaacggctcagcgaaaacggggtattcatattccggacggatgaggacggggcggtgcaataccgctttttcaaagaaaagggaaccttttcaaccgtcctcccataatatacattaattaaggaaccgtccggaatggcttcggcactgcccggagcggggctatctgccaatgatgtctgctgcggtggcaatgataaatatcagcgcaaaaaacaaaaaagagatcagaaaacctgctccggcatcggcaacatcgttcgtttttgactggacatcctgctcgaattcattcatccgaatccctccctgttttttgattatatgataatttcagaacgatttccaccgttttggatggagttgtcattcatagatatccggctgcgtgtgacaataagggtacgggtccaccgttaacggaaaagcttcccgggactgttccgttaacgtttatatagataaaggggattttacggatccccttttccatttgttttctacttgcaaccatgcgcccgttctcttaacatagggagtaagaaaggtttgggagcggaacagaatggatgaattatggaaaaagattgaacgcgggcaattttccccgctttatttattgtacggcgcagaagattatttcattcaaaaaacgaaacaaaagttgctggatcatgcgctcactccggaagaggcggattttaattatgcttcgtatgacctgggggaagtgccggtcgagacagcggtcgaagatgcggagacatttccttttatgggggagaggcggctcgtgattgcgcaccatccgttttttttgactgctgaaaagcaaaaacagaaagtggaacaccagctggacaaactagaagcatacgtgaaatctcccgccccttacacggtttttgtgctggttgcgccttatgaaaaactggatgaacggaaaaaactggtgaaattgatcaaaaagcaggccgcaactttccaggcaaaaaaattaaatgaaagggagcttgaagggtggcttgtttcccgcgccgctgaagaaggctgccggattgacaggaaggctgcggaacacttgatttcgcttgccggaaccaatatgattgcgctcgatcatgaaataatcaagctggccctgtatgccggaagcggtaatgaaattacagatggaatggtggaattgctgacggcacggtcgcttgagcaaaatgtatttgaacttgtcgaaaaagtggttcaccgccgcattgatgaggcgctccggatctattatgaccttttaaagctcaatgaagagccgattaaaatattggcgctccttgccggccagttccggctcatctaccagacgaaagagttggcaaggcgcggctacggccagcagcaaatcgcatcttatttaaaagtgcatccatatagggtaaaactggcggcggggcaggcggggcttttttccgcgggtgaactgaaccggatcatggcgctgcttgccgatagcgactaccagatgaaatcgggcgggctgaaaaaagaaatgatcattgaaatgttcttgtttcaactgcatgaaatgaaggcaaaataaaaaagacgcggattgcgcgtcttttttattttggtgcgttacgcctgttctgataattttttcatcaggcgtgatttttggcggcttgccgcatttttatggataaggcctttagatgcggctttatcaaggcgtttcaccgcatcgactaaaagtgcttttgcgttttcgtcgttgttttcaaccgccgcttcaaactttttcactgccgtgcgcatggcggattttgccgctgtattttgagcatagtttttttcattcacttttacgcgtttaatcgcagatttaatgtttggcacccgtttcacctcctacgagcaaacttagtttggctcgtccactttcactttagaacaaatgatattgtaacaaatggaagacaagattgcaatacatacagccggaatttgcacaaaacgaatggtctggctggaatggggaaaaacaaggataaaggaaatggccaaaaggaggaagaagaacaaatggatctcagtgtttattccgtccgcacagatttagcgattgaagcgcgtgatcttgcagtggaagagaaagtgaagaaccgggaaagcgaagaactggaaggcgtaacggtggaagaacggaccgtaaacgatataaaggtgacgacggttcaaatttccaaaaaaggggaaaaagtcatcggaaaaaaggccgggaattatttgacgattgaaatgcagggcatccgcagcggggatatggacatccagcaaaaggtggaagaattgtttgcacttgagtttaatcaatatttgaaacatttaaatattggtccggaggcgagctgccttgttgtcgggctcggcaactggaatgtgacgcctgatgcgctcggcccgcttgtttgcgaaaaagtgctcgtcacccgccatctgtttaaaatcgagccggaaaatgttgaatcgcgctacaggccggtgagtgcgcttgccccgggggttatggggctgaccggaatcgaaacgagcgatattatattcggcgtcagtgaaaaatcgaaaccggattttattattgtcgtcgatgcactcgcatcccgttcgctggaaagggtgaatgccacgatccagatctcggatacaggcattcaaccgggatccggtgtcggcaacaagcggaaagaattgtcgaaagaaacgctcggtgtgccggtaattgcgatcggcgttccgacagtggtggacgccgtgacgattacgagcgacgcgatcgattttcttttaaaacattttggcaaagaaatgaaagaatcaggccggccttcacgggcgcttgcaccggcagggctttcgttcggggaaaagcggaggctaacggaagaagatctgccgggaagtgaagcacggaaaatgtttatgggaattgtcggcaatctggatgaacaggaaaagcggaaactgattcacgaagtgctcgcgccgctcggccataacttaatggtgacgccaaaagaagtggacatttttatggaagatatggcaaatcttctggcgagcgggctaaatgcggcgctccacccccatgtgaaccaggaaaataccggttttaagacgaggtaagttgcaggcgctccgccatagcccgagggcgcccccgcttttcggtgttctattcttccatgagattcatagaatgtaatagaatcgattggaaagggtgggacgatgaaaagcggcaggcattccagccatttttttatattgaatctgaccagtgtgatacgcctaatctctataatcatcctgtccctcgtgcttgttgtcatcttaattggcacattgacgtcgttgaagccgggataccgggtttcctcttcggctgtcaatgaagccgcaaagcatctttcaagcaaaacattgtacaagtacctgctgtcggacagccagctgcttgtacaccattttccggatacggacgagcggccggtcggaaatctcgtgtttgaaatgctcaccaacatccgctttgaagacccgcgcagctttctcgggcgtgaactgccgggatttgaaatctttgacagcaaaatccttgttgccggagacggcgctgactatacgaatatgccgattgaatccgtcccgcctgacagcgccttgcaatcgaaagatccggccacacaaaatacggaaaaaatcgaggaaaatggcggatcggacgatgcaaaacagcggcccgggcggacaacgggcggcaagaaacgggtgttgatttattttacccatacacatgaatcctatctgccgtatttaaaaggcgtcacgaatcccgaccttgcccagcattcgaagatcaacgtaacaaaagtcggggcgaggctcgcgcaggatctcgaggacaagggaattggcgcagaggcgaatacgactgatgtgttgaagctacttgagaaaaaccatatgcagtattaccagtcttaccaaggatcgcgcaccgtcgtcgaatcggcgatgaaaaacgaccgcgaccttcaatattttattgacatccaccgcgattcgagaagaaaaaaagatacgaccgttaccatcaatggaaaatcgtatgcaaaaattgcttttgtgatcggcggggaaaacccgaactgggaaaagaatgcaaagctggctgaggatttgcataacttgatcaaaaagaagtataaaaacctgtcaaggggtgtcattttgaagaaaggggcgtcaaccaacggaaaattcaaccaggatttatcgggaaatgcttttctcattgaagtcggcggcgtggataatacttttgaagaaatgtaccggacgatggatgtttttgccgatgtgttcgctgggtattactggcaggcggacagtgtaaacggcgccgggagcggacaatcaggaaaccgttagccgtctgaacaggcggttctttttttggcgaggcgcggctgatcatttttcgttgaagtcgcgctttcctgctgatataatcagaaatagtgtacatgtgccgaatacaggagtgaaggtaaatgatgaaccgtgaagaaaaattagacaggcagaggaggatccgcaacttttccattattgcccatatcgaccatggcaaatcgactttggccgaccgcattctggaaaagacccatgcgctgagcgagcgcgaaatgaaggaccagctcctcgattcgatggaactggaacgggaacgcggaattacgatcaaattaaatgccgtccggctgaactataaagcaaatgacggggaagaatacattttccatttgattgataccccgggacatgtagactttacatacgaagtgtcacgcagccttgccgcctgtgaaggagcggtgctcgttgtcgatgccgcgcaaggggtcgaggcgcaaacgcttgcaaatgtttatcttgcattggataacaatcttgaaattatcccggtcatcaataaaattgacctgccttccgccgatccggaacgcgtccagcaggaaatagaggatgtgatcggccttgatgcatcggaagccgttcttgcttccgctaaagccgggatcgggattgaagatattcttgaacaggttgtcgaaaaagtaccggcgcctgagggggatccggatgccccgctgaaggcgcttatttttgactcgctgtatgattcgtaccgcggcgtgattgcctatatccgtgtaatggaaggctctgtcaaagtcggggataagattaaactgatgtcaaccggcaaggaatttgaagtgacagcgcttggcgtaagcaccccgaaaccgttgtacatagacgaattaactgtcggcgatgtcggatttttaacggcatcgattaaaaatgtaaaagacacgcgcgtcggcgatacgattacaagcgctgaaaatcctgcaaaagaggcgcttcccggttaccggcggatgaatccgatggtttactgcggcctgtacccggtagacagcgcgaaattcaatgatttgcgggatgcccttgaaaagctggagttaaatgattcgtcgctgcaatatgagccggaaacatcgcaggcgctcggttttggtttccgttgcggttttctcgggctcctgcatatggaaatcatccaagaacggcttgaacgcgaattcaacattgaactgattacgaccgcgccaagcgtcatttataaaactaaactgacggacggcagtgaagtgacagttgataatccggcgaatttgccggaaccgcagaaaatcgaatatatcgaagagccgtacgtgcgcgcgtccattatggttccgaacgattatgtcggcgcagtgatggaaattgcccaggcaaaacgcggcaattttatcgatatgcagtacctcgatgatatccgtgtcaatgtcatttatgaaatcccgctctctgagattgtatacgacttttttgaccagctgaaatcgagtacaaaagggtatgcttcctttgattacgaattgatcggctacaaacagtccaatctcgtaaaaatggatattttactgaatggggaaaaagtggacgcccttagtttcatcgtccaccgcgactttgcgtacgagcgcggcaagacgattgtcgaaagattaaaagaactcatcccgcgtcagcagtttgaagtgccagtacaggcggcagtcggccagaaaattattgcgcgttccaatattaaagcattgcgcaaaaacgtgctttcaaaatgttacggcggggacatttcccggaaacggaaactgcttgaaaagcaaaaagaaggtaagaaaaggatgaagcaggtcggttctgttgaaatcccgcaggaagcgtttatggctgtgctgaaaatggacgagaccccgaaaaaataaccggagcgggcagggagcggattggcggctgtccgcgcgctcctttttccgggacatgcccgtgatgaaaacaaataaggttgtgatgcaatgaaagccgcatatattcatgttccattttgtgaacatatttgctattactgcgatttcaataaatttttgttaaaaggccagccggtggatgaatacattgagatgctgctggaagaaatgcggatcaaaatggctgaagccccttgtgaaaagatgagcacggtctttgtcgggggtggcacgccgaccgcactgaatgagaggcagcttgaaaaactgcttgccgcaatccgcacgatcctgccttatgacggggacggggagtttacatttgaagccaatcccggggaaacgtctgaagagaagctgcgcctcctgcatgactacggtgtcaaccggctgagtttcggcgtccagtcgttcaatgaccggttgcttgagaaaatcggacggacccaccgccgggaagatgtctaccggacgatcagccatgcgagaaagatcggtttttccaatatcagcatggatttgatgttcgcgcttcctgggcagacgcttgaagatttccgcgaaacgcttgacgaagccttgtcgatggggctgccgcattattcaagttattcgctgatcattgagccgaagacgattttttacaatctgctgcggaaaggaaaactccgcttgccgtcacaagatgcggaagcggatatgtacagcatgttaatggacgagatggaaaagcacggcctaaagcagtatgagatcagcaattttgccacacccggctatgaaagccgccacaatctcgtctattggaataatgaagaatatttcggtttcggcgccggcgcccatgggtatgaaaaaggtgtccgcctgtccaattacggcgcattgaaaaaatatatcggcatgctccgggacgggtgcctccctgttatggaaacacatacagagacaaaaaaagaaaaaatggaagaagaaatgtttctcgggctcagaaaaaacgaaggcgtccgtttccgccatttccgtgaaaaatttggagtggatatgaaagaagtttttgcaggcgcgatcaaagaaatgacagaacgcgggcttcttgaagaaaagggcggttctctccggctgacaagggaagggcgttttctcggcaatgaagtctttgaagcttttctcctcagttgacgcttgatgtaaatatattgacaacaacaggggattttgttaatttatttatataaattagcactcgtttatacggagtgctaacaggggtgatggaagttgttaactgatcgtcagctgttgattttgcaagtgatcattgatgactttattcgttccgcccagccggtaggttccaggacgctttccaagaaaaacggcatttccttcagttccgcgacgatccggaatgaaatggcagatcttgaggaacttgggtttattgaaaaaacacatacgtcatccggcagggtaccttctgaaaaagggtaccgttattacgtcgatcatcttctgtcgccacaaaaactgggaccggcagacatatcgcagcttcattcgatttttgccgaaaaaatagacgaaatggaagagcttgtgaaaaagtctgcccaaatcctttccgaaatgacgaactacacggcgattctgcttggcccggaagtcaaagatacgaaactgaaaaatatgcagatcgtcccgctgaatgaaaaaacggcggttgccattatgattaccgataccggccgcgtggagaacaagacgatttcgctgccggaaggattccgcccgggcgaacttgaaaaaatggtcaatatttttaacgagcggctggccaatgtgccgattccggatttaagggataaaatatataaagaagtcgctgacattttgcgcagccatactgaaaactatgaatcgatcctgaagaccgtaatcagcatgttcaacgaaaaccggcatgataaaatttttgtcggcgggaaagccaatattttgaaccagccggagttccatgaccttgagaaagtccgtccccttcttgatatgatagaacgggaagacagtttttatgacctggtcaaacgcgtgccgagcggcattcacgtaaaaatcgggaaagaaaaccagatttccgagatggcagattgcagcatgattacagccacctattcgatcggtaaccagccggtcggcaaaattgcaattttgggccctacgcgcatggaatattcacgcgtcatcagcatagtggatttcttgagtaatgatatgaccaacgccttgacgaaactgtatgacggataggcaatacgggcatattgggtagggaggcttaaagcgcaaaagcacatgctttaagtcctttcttactggacttttttatgcccgtctcattttaaagggggtgaacgctcatggcagacgaacaaaacaaacgtgcttcagaagaagtgaaagacgaacaaaaacgggcttcggatgaagtgaaagaaggacaaattgaatccgtttttgcggaagaaaaagatacggaaaatcagcaggcgccgccagagggcgaaggtaatggagcggaaaaggcggagaagcctgaaaccgaaaatgccgctgaagaactgaaaaaagcaaaagaggagattgagaaattgcggaatgagctcgatcaggctgaaaaccgttatctccgcctgcgcgcagattttgacaattacaggcgccgcgtaaatctggaccgcgaagcagccgagaaatacagggcacaggatctgattgtgaacctgctgccggcgcttgacaattttgaacgcgcactgtccatggctgaaaaaaatgaacatacggcccagttgctggacgggatggaaatggtctaccgcagcattttggaggcgctgaaaaaagaaggcgcagaaccgattgaagcactcgggaaagaattcgacccgcactatcaccaggcgatcatgcaggggcaggaagaaggcactgcgtccaatgttgtgatcgaggaattccaaaaagggtacatgttaaaagacagggtgatccgcccgtccatggtgaaagtgaacgagtaacgcgctttacataatttttaagggaggcattatcatgagcaaaattatcggcattgacttaggtacgacgaactcatgtgtcgcagttttggaaggcggcgaaccgaaagtcattccgaacccggaaggaggcaggacaacaccgtctgttgtcgcttttaaaaacggggaacgccaggtaggggaagtcgccaaacgccaggcgatcacaaatccgaatacgattatctcgatcaaacgccatatgggcacgacacacaaagtcacggcggaaggaaaagaatatacgccacaggaaatttccgccatgattctgcaatacttgaaatcgtatgcggaagattatctgggcgaaaaagtcgaaaaagcggtcattacggtccctgcttatttcaatgatgcccagcgccaagcaacgaaagacgccgggaaaattgccgggcttgaagtcgaacggattatcaacgaaccgactgccgcagcgctggcatacggccttgataaaacggatgaagaccagaccatccttgtatttgaccttggcggtggtacatttgacgtctccatccttgaactcggcgacggcgtctttgaagtgcacgcgacagccggtgacaaccatctcggcggcgacgacttcgaccaggccatcatcgattaccttgtcagtgaatttaagaaagaacacggcatcgacctgtcgaaagacaaaatggcgctccagcgtttaaaagatgcggctgaaaaagcgaaaaaagatttgtcaggggtcacttccacccaaatctcgctgccgtttattacagcaggggaatcaggcccgctccacctggaaatgacgttaacccgtgcgaaattcgacgaactgacggcagaccttgttgaacggacaatgggcccgacacgccaggcgttgcaggatgcagggctcacggcgaatgacatcgataaagtcatcttagtcggtggctcaacccggattccggccgttcaggaagcgatccgcaaagaaatcgggaaagaaccgcataaaggtgtcaacccggatgaagtcgtggcgatgggtgccgcaattcagggcggcgtattgaccggggatgtgaaagacgtcgtgcttctcgacgttacgccgctgtcgctcggaattgaaacaatgggcggcgtgttcacgaaattgattgagcgcaacacaacgatcccgacttcaaaatcgcaaatcttttcaactgcagcggataaccagacagccgttgacattcatgtcctgcagggcgaacgcccgatggctgccgacaacaaaacgctcggccgtttccaattgaccgatattccgccggcaccgcgcggcattccgcaaatcgaagttacgtttgatattgataaaaacgggattgtcaatgtcagcgcaaaagaccttggcactggcaaacagcaaaagattacgatcaaatcgtccaccactttgtccgatgaagaaatcgaacggatggtaaaagaagcggaagcgaacgcagaaaaagacaagaagcgcaaagaagaagcggaactccgcaatgaagccgaccagcttgtattcactgctgaaaaaacattgaaagaactggaaggaaaagtggacgcatctgaaatttccaaagccgaaaaagcaaaagacgaattaaaagcggccattgagaagaacgatctcaatgaaatcaggcagaaaaaagatgcgctgcaggaaatcgtccaagacttgtccgtcaagctgtatcagcaggcggcacaacagcagcaaaacacggatgccgggggagacggaaaaaaagatgacaatgttgtcgacgctgattttgaagaagtcgatgataataaaaaataacgataaaacaatacggcccatttcagcatgagtcaggaaaaaagtcaaagtctggtctattctcggctttgacttttttcttatgcgaatgctacaattacctttatgtgaacgtttcgggagtgagaagaaatgagtaaacgggattactatgaagtgttgggcgtcgcgaaagatgcatcgaaagacgagataaaaaaagcgtaccgcaagctttccaaaaaataccacccggatattaacaaagcgcctgatgctgcagaaaaattcaaggaaatccaggaagcgtacgaagtgttgagcgatgaccagaaacgcgctcaatatgaccagtttgggcatgcagggccgaaccagggcttcgggggcggaaacggttttggcggattcagcagctcggattttgacagtttcggttttgaagatattttcagcactttctttggcggtggcagaagaaatgacccgaatgcgccaaggcagggggctgatttgcaatatacgatgacgcttgaatttgaggaagcggtgttcgggaaagagacggacatccggattccgcgcgaggaaacttgtgacacctgccacggaaccggggcaaaaccgggaacgcatccgaaagaatgcccgcactgtcacggaaccggccagctcaataccgagcaatcgacaccattcggtcggattgtaaaccgcagggtatgccattactgcggcggtacaggcaagatcattacagacaaatgcaaaacttgcggtggtaccggaagagtgaaaaagcgccgcaaaattcatgtcaaaattccggccggcatcgatgacgggcagcagctccgcgttgcaggccagggtgaaccgggcataaacggcggaccggccggcgacctgtacattattttccatgtccggccgcatgaactgttcgaacgggacggcgatgacatctactgcgaaatcccgattgcttttacccaggctgctttaggcgacgaaatcgaagtgccgacgttgcacgggaaagttaaattaaaaattccggccggcacacaatccggcacgaaattcaggctgcgcgggaaaggcgtgccaaacgtccatgggcacggcaccggcgaccagcatgtcatcacgagaattgtcaccccgacgaagctcaccgaacggcaaaaacaactattgcgtgaattcgccgaagtgagcggagaggtcccggatgaacaaagcagcaatttttttgacaaaatgaaacgggcatttaaaggggactaaacaggaatggagtgaggcgttcatgaaatggtcggaaattatgattcacaccacgaatgaagcggtggagccgatttcgaatattttatatgaagcgggcgccggcgggattgtgatcgaggactcggatgagctgctgaaagagcacgacgaccagtacggtgaaatttatgaactggatccggacgattttccggaagaaggggtcatcattaaagcctatctgcctgtgaacagctttttaggtgaaactgtcgaggaaattaaacaggcgattaccaatctgaccacttttgatattgatatcggcccgaacaaggtgacgatcagcgaagtgcatgaagaagaatgggcaacggcatggaaaaaatactacaatcccgtgaaaatatccgaaaaatttacgattgtgccgacgtgggaaaattatgagccggtatcaagcgatgagctgatcattgaactggaccccggcatggcgttcggcaccggcacccatccgaccacggtcatgtgcattcaggcattggaacgaacggtaaaaccgggcgacacggtgatggatgtcggcaccggttccggcgtgttaagcattgccagcgccatgcttggagcagagcgggtgcttgcacttgaactggacgaggtggcggttcgggcggctacgctcaatgtgaaactcaataaagtccaaaaccgggtaaccgtcaaacaaaatgatctgttgaagggcgtaaacgaacaagccgatgtgatggtggccaatattcttgctgaagtgatcgcccgttttgctgaagacgcattcggacatgtcaaaccgggcggccattttattgcttccggaattatccggcaaaaaaaggaccttgtcgtggacgcactcacttctgccggcttcatcattgaagaaacgatggtcatggaagactgggttgcgctcatcgcaaagcgcgggtgattggccatgcagcgttattttttggatcggccgtatcgcggtgagcaggaaatccgcctgagtggcgaaaattaccatcatatcgcgcgcgtcatgagaatgtccgtcggaagccgcttctatggtgtattttcagatgaaaaggtgtgcatttgtgaaatcggggagattacaggtgatgccgttgtggcccggattaccggatgggaaaccgctgtaaaagagcttccggtccatgtgacggtatcatgcggactcccgaaagcggataaactggaatggatcatccaaaagggaacagagctcggcgcctttcaatttttgcctttccttgcagaaagatccgttgtaaaatgggacacaaagaaagaagcaaaaaaacgcgaacgctggcaaaagattgcccgggaagccgcagaacagtcgcaccgcagccacttgcctaaagtcagcccccctgtttctttccagcagctgatcgaagaaagccatacatatcaatataagctggttgcttttgaagaaaatgcaaaagaaggggaacagcaccggtttgcggaaatgttgtcaaacatgtcggaaggcggcaatgtactggccgttttcgggccggaagggggcctgtcccttgatgaaatcaaaaagcttgaagcagccggatttgtatcctgcggcttaggtccgcgcattttgcgggcggagacggcgcctttatatgtactttctgccataagttaccattttgaattaatgaggtgaagaggatgtcaaccgtagcattccatacattaggatgcaaagtgaaccattatgagacggaagccatgtggcagctgtttaaaaaagcgggctatgaaagaaccgactttgaaacgaatgccgatgtctacgtgatcaatacctgtacggtcaccaatacaggagacaaaaagagccgtcagatcatccgccgggcagtccgacaaaacccggacgccgtcgtttgcgtgaccggctgttatgcgcaaacctcgccgggcgagatcctcgaaattcccggtgtcgatgtcgttgtcggcacacaggaccgtaccaaaatgcttgggtatattgaacagtacctgaaagagcgcaaaccggtcaatgctgtgaaaaatattatgaaaaaccgtgtgtatgaagaaatggaagtgccgtattttaccgaccggcaccgggcttccttgaaaatccaggaaggctgcaacaatttctgcacattttgcatcatcccgtgggcacgcggcctgatgcggtcaagagatcccgaaaaggtcatcgcgcaagcccaaaagcttgtcaatgcaggctataaagaactggttttaaccggcattcatacgggcggctacggccaggacttaaaagattacaatcttgcaatgctgctaaaggacctggaggaaaaagtgcaggggctgaaacgcgtccgcatttcgtccattgaagccagccagctgacggatgaagtgattgacgtgattaaacattcgaaagtcgttgtccgccatatgcatgttccgatccagtccggttctgacacggtgctgaaaagaatgcgccgaaaatatacgatggaccagttcgcggaacggattaccaaattgaaagaagcattgccggatcttgcactgacttctgatgtcatcgtcggcttcccgggtgaaacggaagaagagtttatggaaacatacaatttcataaaagaacaccggtttgcggaactccatgttttcccgtactcgcctaggacaggcacgcctgctgccagaatgaaggaccagattgatgaagaaatcaaaaatgaacgtgtccatcgcatgattgcattaagcgaccagctggcaaaagaatatgcatcccaatttgaaaacgaggtgcttgaagtcattccggaagagccgttcaaagaagatccggaaagcgggctgtacgaaggctatacagataattacctgaaagtcgttttcccggccaccccggatatggttggaaaactcgtcaaagtgaaaattacaaaagccgggtatccttataatgaagcacagttcgtcagagtgatggacgatgtcatgccggccgtaaacgaagccatgtaacgaaaaacaagatgggcctgtttgcccgaaaaggcgtgcccgatataaaggcagccccccacaaacagaatggcgtttaagaggccggggcagctttcggataaaatgcccatcctttaaagcatatggcaaaaacaaccgggctttgggcccggttgtttatttttttccatgaaaagcgatgataaaccggccaaatctttcggaaaagggcaaaacagccagtgaggatagaagattaaacaataggcttgcatgggcaagctgctgttccggattagccgacagcatccggcaggtgtccgcgagcacatggaggaaaggcaaaaacacaagcgcccctccggcattcagccagacatgggtaaatgccgtcagccttgcttcctctccggccccgatgcttgccagaagaccggtgatacatgtcccaatattggccccgagcatgatgctaatcccggtttcaagcgggaataccccggctgcaagaaaacccatcgccatcccgatcgtcacggtgctagactggatcgctgcagaaagcaagattccgagtaagaaagcggacaagaggtgggtatttaaaacggtaaacaaatgctggacaaaagcggtttttgataccggcacggcaagctgctcaaatccgcgcatcgccccgaacacaagcgagaggccgaacagaatcatcccggcgcttttgacgcggccttttccgaaaaaatagaaaactgcccctgcccccaaaaaaggcaggctcaaagaggagaagtcaaatgtcagcaattcaagtgtgaaagtcgtgccaatattcgtgcccaaaatgattccgatcgattgcgaaaacgtcagcattccggcagaaacgagcccgacagtgatgaccatcacggcggagctgctttgtaaaagcgccgtcaaaaccatcccgaacagcatcgcggacagcggccggcctgccagttttttcagcatgtttccggcatggccgccggataaggcaaacagcccggtccgcagccggtgaatgccgaataaaaacgtcaccgttaacaaaagaaatgaaagtaaataaagcatgtccttccccccgtatgatcatatggaaaggggagaaggaacatgcctttttatttgggaattcatttaatacaacacacgaaaatcacggtactgttcttgttgctgtaaatagtcaatatccattccggttacttttgcaaagcgcgacggcccttttttcagcccgcggataaattgttccatctcttttttctcgccttgcgccatcacttcgacagtgccatcgtctttgttgcggacccacccgcatatattgtattgttttgccaaaaattgggtttggtagcggaagccgacgccctgcacccttcctgaaacaatgatatgtagcgtctcctgttgattcatcgtctccctccaatcgtatccatccatctttgatctctattataccaaaaggaggaacaggcggggcaaataagcaaaagccaaatcacgaaagacaaggcgcaaatgttgaccggttatggaggatattatataataataaagtgcacgggttgctcaacctgacatgtaaccgtttgtgttcggagggagggaaagaaatgtctaaaactgtcgttcgaaaaaacgagtcgcttgatgatgcgcttcgccgctttaaacgtactgtttcgaaaaccggaactttacaggaatatagaaagcgcgaattttatgaaaaaccaagcgtaagacgcaaaaagaaatcagaagctgctagaaaagctgctaaaaaacgtaagtggtaagagagggtggaatgatgagtcttctcgagcgtttaaatagcgatatgaagcaagcgatgaagaacaaagataaagaaagactctccgtaattcgtatgcttaaggcagctgttcaaaacgaagcgatcaggctcggaaaagacggtttgacgaatgatgaagagttaacagtcctttctcgcgaagtaaagcaacggaaagactccctccaagaatttaaaaatgcaggtcgcagtgaccttgttgaaaaagtccaaaacgaattggcatatgtgaacgcatatttgccggagcagctttctgaagacgaagtgcgtgaaattgtccggcagaccattgaagaagtgcatgccgggtcaaaagctgatttcggaaaagtcatgggagccgtcatgccaaaagtaaaaggcagagctgacggtacggttgtgagaaatattgtgcagcagcaattatcctgacctttctcatataagccggaaatcattatgatttccggcttttcgctatgttttttgcgcctctttgccgtatccttgagcaggaaacgcgggtttccaaacggccccggacgtttcggacaaaaaaactgcaaataaagtgatgaaccccttttttgtttcataaatatgagatgaaagggggttctttttatggcaaaaaaatggcggcagcatttgcaaaactggatgtcacaaaaaatggaccttccgcaggatgtcatgatggaccttccgagaatcacgatgatcggccaaatccatatttatgttgagaaccaccgcggccttttgactttttccgataaagaagtccggctgcttttaaaaaacgggcagctgttaatcaaaggccggtcttttgtcatcaaaacgatcttgcccgaagaaattttactggaaggcaaaatagatgaagtgttgtatttgaacggataggggtggctatggttgaaaaatcattgggtaacttttttacaggggtcggtggctgtaaaaattgagggaaaagggatcgaacgttttatcaaccagctgacaagggccggcctcgctgtttggaatgtcaggcggcagggcactatggccgtcacgttcgaattgcgcctttcagacattcaccagctcagaaaagcagtaaggggacaagatttgcatgtccgctttttaagggggcgcggcgttccttttttatggaaaaggacgctgaaaaacgccggattcctgttcggtttttttctctttcttgccgtgatcacggtgctttccaacatggtttggggcgtggagatcaaaggtgcaacaccaaaaaccgagcacgaaatccgcaaacaattggacaaactgggtattcaaacagggcattcacagttttttctcgatgatattgaaaccatccagcgcaagctgacaaacaatcttccggacgtgacatgggtcggcgtggagctgcgcgggacaacctatcattttaccgttgtggagaaaaacatgccggaaccggtgaaacatccgggcccacagcatcttgtcgcttcacagaaagcagtggtggaaaatatgtttgttgaaaaaggtaagccggttgtaaaaattaaccagtatgtgaaaaaaggccagctgcttgtttccggtgtcattgggaatgataaagaaaaataccctgtggcagccaaagggaaagtatacggaaaaacgtggtataaaacggcggttgaacttccgctttcctctcgttttcaagtctacaccggcaatgcagcccaaaaatattatattggaatcgggtcgatgaagctgcacgtatggggcttccggaacccccgttttaaacagtaccggacatcggaagaagcagaaaaagtcaagtttttaaaatggacattgccgatccgctttatcagggaaacggtccgtgagaaagaagagcgggacagaaattataccaaaaaagaggccgaagcagaagcaaaaaaattagcaaggcaggatttgcacaaaaaactgccaaaagaagcaaccgttacggatgaatatgttttgcaagaacatgtccgcaatggtacattaaaaatgatgatttattatgaagtagtagaaaatatcgcaatcgcaaaaccaattgctcaaggagacttagaatgacagaagaaagtacggcaaaacttcaattggagaatacaaacgaagcagtgcttttattcggcatttccgaccatcatttgaaaatgcttgaggatgcctacggggtccacatcctcacccgcggcgaaacgatccaggcaagcggcaaagaagatgcggcacaaagggtgatcgccgtcatgtccgaactgcttggtttgattaaaaaaggcatcccgatcagcgggcgcgatgtgctttacgctgtcgaaatggaaaaaaagggccatcttgaatatttggcaagcctgtacgaagaagaaattgcccggaatgcgaaagggaaagcgatccggatcaagacattcgggcagcgcgactatatccaggcaatccgccatcatgaccttgtgttcggcatcggcccggccggaacggggaaaacgtatttggctgttgtcatggcggtgaatgctttaaaaagcggcgaggtaaaacggattattttaacccgcccagctgttgaagcgggggaaagcctcgggtttttgccgggggatttgaaggaaaaagtcgatccgtatttgcgcccgctctatgatgcattaaacgatgtgctcggcgcggagcatacacagcgcctgattgaaagggaaacaatcgaaattgccccgcttgcctatatgcgcgggcgcacgcttgatgatgcgttcgtcattctcgatgaagcgcagaatacgacacaggcacaaatgaaaatgtttctaacgcgcctcggttttcactctaaaatggtgattacaggggacagaacgcagattgacctgccaaaaggcgcggaatccggccttttgacggctgaaagagtgctggagaaagtccgcggcatttcattcgtctatctggaagaaagtgatgtcgttcgccacccgcttgttgcgaaaattatcgaagcttatcaaaacgcataacccgggctgtggcacccgggttgttttgccatgcatttttgccggaaaactgatatgatggtaccgttaagagcgattgcaaaaggcggtgtacgaaaagcaaatgaaaattcccgggcaaatgggcaggttgcggatgatgttaagctttaaatggtttacattcgtgatcctgtttttactggcccttattttattcggcattttttatccgaacatcaggccacagacgtatgatattaagttattttcagttgcgaacaatacgatccgttctccaaaaacgatcgtcgatgatgaaaaaacaaaagaagaaaaacagctggcggccgccagtgttgcgaaagtctatacgtttgacagcggcctggcacaaaaccgggtttcgctgatggattcgatttttgacgttgcagaagaagtgaacgcggaatataaaaataaaaaacacggcggaaaaaacagcagcgggctgcaggaagagaagctggcaaaattgaaggaaatattgtctgaaaatgtgtccggcaatgtgaccggttcgatttccgacacaagttttcgcgcgcttttgtccgctaccccggatgaattgaaagcggcaagaaacattgtcgaaacaaatgtcaatgaggcacttagccaaaaagtgacagaaaacaatgcggctgaagccaaaagccgggtggcctcgcaaatcgaaaggtcggggttaaaagcgggtatccggaatgctgcgtccgagcttggtcaatatgcgatcgtgcccaattatgtgtacgatgcaaagctgacggaaaaaagaaggcagcaggcgagggataacgttgaaccggtgaaaatcctgcagggacaggttatcgtccaggaagggcatctgatcgaccgggaaacttaccgcgaactccagctgctcgggctgttaaaaagcagcggatcggttaagccgtatatcggattggctttatttgccttttttgcatctggcgttttgtacctctatacgagccggatgcgcgcaacggaagaagaaaagcaaaaccggcttgtcatggccgggctgattcttgtcatcgccctggcattgatgaagctggcgggtattttaacccatcttgagattccgggtatcgaatacgcttatccggccgcaatggcgccgctgctcgctcggattttgctcagggaccgttccgcatttttgctttcagccctgcttgccgcttgtgcgagcatcgaatttcatggcgacattgcagatacatttaacgccgagatggttgtatacgcgcttattacagggacagggggcattttgcttttaccgaaacggccggagcgcacccggttgtttcaaaccgggatttttgcagcgctattgaatgtgcttgccgtctgtgtcatctattttttgaatgccggccaaatcgtaaaagcggactttttatatacccttttatttgcgtttctttccggcattttgtccgctgtgttcgtgatggggctgcagccgttttttgaagcagcgttcggcattttgtcgccgatccgccttgtggagctgtccaatccgaaccacccgcttttgaaaaagattttaacggaagcaccgggcacgtatcaccatagcctgatggttgccaatcttgccgaagcggcttgtgaagcgatcggggcgaacggcctccttgccagggtcggcagttattatcatgatatcgggaaaacaaaacggcccgcattttttatcgaaaaccagctgaacgtcccgaatccgcatgaccgcctttcgcctgaaacaagcagggacattattattgcccatgcgaaagacgggtcggaaacattgaaaaaatataagctgccgaaagccttttcggatattgccgaacaacatcacggcacgactttgctgcagtatttttaccataaggcaaaagcgcaaaacccggatgtaaaagaagaagcgttccgttacccaggtccaaagccgcagacgaaagaagcggctgtcatcaatattgcggacagcgtggaagcggctgtccggtccatgaaccatccgacgcccgatgatattcaaaatttagtcggcaatattgtgcaagggcggatcatggatgggcaatttaatgaatgtgacattactttgaaagaactggagaccgttaaacgcacgctttgcgagacgcttaacggcatctttcattcaaggatccagtatccgaaataaggatcccgtaaaaataagaaaaaggatggctgacatgacattatcactcgatatgatggatgaaacaaatgagcttgaagcggagcatctcgagcttgtccggacattgctcgattatgctgcccgtcaggaaggggtggaggacggcaccgagttgtcggtaacgtttacggataatgaagggatccgcgaaatcaaccgcgattaccgcggcaaagaccagccgaccgatgtcatttcgttcgcgcttgaagaaatgggggaaggggagatcgaaattactggtgcagaaataccgcgcgtactcggggatatcattatttccgtgccgcgggcaagggagcaggccgaagagtacgggcactcgtttgaaagggaactcggctttttggcggttcacggatttcttcacctgctcggctatgaccatatgacaaaagaagatgaaacggaaatgttcgggcgccaaaacgagatcctcgatcgctatggacttaaacgataaaaaaatcccgaaataccgcacccctttccggccggctgtggaaggactgtttgcaaccatccggcaggaacggaatttccgttttcatcttctggcggcgttttgcgcttgtttgctcggctttttcttctccctttccaaaacagaatggatcgccattttaatttccattttcggcgtgatcgcaatggagctgatgaacacagcaattgagcgggcggttgacctgactgtcgggcagaaataccacccgcttgccaagcttgcgaaagacgcagcggcggcagcagtcctgatgtgggccgtgcttgcggccattatcggctgcatcgtatttcttccaaaattatggcatgtattccagggagcggctttttaatgcggcttcttttttatggccctcccccaaatgtccttacctgcgcgatttcggcgtaaaaaagcagatgccctgcttcagccggactgtcgtacagaaacggcatacgagatctggtatgtgtaaaattttactcgaagggcagatgagtggaaaaaatggggagacactctattatctaaatgtacaccgttaaatgaacatcaagagagaggtcttcccatggatatgccgcaatttgaaaggcacaggccgttgcgctaaaataaaggtaatcacactacttgaaaacggccatggcatactaagtgacgctaaaatcagtgtaaattcaccacgagtcgacaatattttcacgaacttttaaaatattcaaaagtgatgaaaaatacattttaactttcgggtctatttgtagtaaaatacaggtaaggggaaaagatatggaaacaatggtaaagctgctttcgggcacttattcaacggaggatttgcatggaacaaccaacatataaatcaggctttatttctatcattggacgcccgaatgtcgggaagtccactttcatcaaccaggtggtcgggcaaaaaatcgccatcatgagcgataagccgcagacaacacggaataagatacagggcgtttacacagctgatgacgcacagatgatttttatcgatacacccggcatccataaaccgaagcataagctgggcgatttcatggtaaaatcagccacggatacattaaaagaagtggacctgattctatttatggtcaatgcggaagaaaaacgcggccgcggggacgagtacattatcgaactgcttaaacacgtgcgcacgcctgtttttttggtcatcaacaaaattgacctcgttcatccggatgatttgcttgccttcatagaacagtacaaagatttatacccgttccgtgaagtggtcccgatttccgcactcggaggaaacaacgtcagccggctgctcgataccatcaaggcatatttgccggaagggccgcagtattatccggcagaccaggtgacagaccatccggaacgctttatcatttcggaactgatccgcgaaaaagcgctgcagcttacaagagaagaagtgccgcattcgattgcggttgttattgaaaaaatggagcgggaagagaacaaggatgtcattcacgtgatggcgacgatcgttgtcgaacggccgtcccaaaaagggattatcatcggcaggcagggaagcatgctgaaagagattggcaaaagagcaagggctgatatcgaaaatttgcttgggtcgcaagtttatttggaattatgggtaaaagtgcagaaagattggcggaataaaatcagccagctgcgcgatttcggtttccgggaagacgaatattgattttggcgcccgcttctggttgtaaatttttaccccgaatgtttgcgtgtcccctggtgaagctataaaaggcttttaaagaaatttcatgacctacaacatgaaaggcgtggtgaatatgttagaatttacctggaaagtctttgcggataccggcaatattgatacgtacctgctttttaaggaactggaaagggaccggcgtcaagaccggtatgaacgtgaagaagatccggcagatgcggatttttccattacttaaggataagccgtactgcctgtcgggcaagaggtggagaggttgtttgaaaaatgtgaagggatcgtcattaaaaatacagactacggcgaatccaataaaatcctgcatatttacacaaaagaatttgggaagctaggctttatggcgcgcggagccaaaaagccgaacagccgactggcggcggtttcccaggtttttacatatgggaatttcctttttcagccgtcgcgcggtcttgccaccctccaacagggagagaccgtttcaccgatgcgccatatccgcgaagatattttcaaaacggcgtatgctgcctatgtggtggaacttttgggccgggcggtcgaagataaaaaaaagaatccgtctttatttgagcttttgctccggacgctcgaatatatcgatgaaggctatgacccggaaattatcagggacatctttgaaatgaagatgctgaatgtactcggtatgtacccggtgatggacaaatgtgcggtatgcggcaacacggaagggccctttgctttttccatccgggaaaacggccttctttgcccccgctgttttgcgcgcgacccgtaccggctcccgttgtcacagcctgcgatccgcctgctccggcttttttattttctggacatcaaccggctcggcagcatttctgttaaagactcgacaaaaaaagagctgagaacggcgatttccatgtactatgatgaatataccggcctgcaactgaaagccggccggtttcttagccagatagagtcgctcgaaaaaaggctcgggccggacaatgcataagacatccccctatcgaagaaaaagggggactttccttgctgcccggggccggatgatgcatcgcacggcccgcggttctgctttaactgtttttgcccggccgaaaaatcatgacccgctatctgagtatacgcagctgtcttccaaaatatcaatggcatttttatgtatcatagtggcagataaggacagatttccgtaaatgtgttatactattgtcttgcatggttgtgtgaatgaaggcggtgattacgatcgaattaacgaaaaggcaagaacagattctcgagatcgtcaaaacgaacgggccgattacaggcgagcacatcgccgaaaagctgaatttaacgagggcaacactccggccggatcttgccattttaacaatggcaggttacttggatgcacgcccgcgcgtcggctatttttataccggaaaaacgagcacgcagcttcttacggaaaatttaaaacatatttacgtaaaagattatcagtctttgccggtcgtggtgaacgagaatatgtccgtgtacgatgccatcgtaacggtttttcttgaagatgtcggcacgctttatgtcgtcgacaatgcatcccatctgatcggtgttttgtcgcgaaaagatttgttgcgggcaagccttggaaacaaagacctatcggcattgccggtgcatatcattatgacaagaatgccgaatattacctgctgtaaaaaagatgatcttctgattgatgtggcaaaaaaactgattgaaaaacaaattgactcggtgcccgttgtgaaagaaacagaaagcgggcttgaagtgaccgggcggataacgaaaacgaatatcacgaaagcgttcgttgaacttgcagacggcgattaaaaaggaagtgatcatttttggcaaaaccccatatttatattgtttcagactcggtcggagagacggcggagctcgtcacaaaggcggccatcagccagtttgaaaaccaggacgcagaattaaaacgcttcccgtatgtggaagatacgatccatattgatgaagtggtttcgcttgcatccatgaatttcggcatgatcgtctatacgcttgtgaagccggaaatgcggaaatacatgaacgaccaagccgtaaaacacggccttgctgctgtcgatttaatgggacctctcatggaccggctgctcgaattgtatgaatccaagccgctctatgaaccggggctcgtcagaaaattggacgaagcttattttaaaaaggtggaagcgatcgaatttgcggtgaaatatgatgacggccgggatccgcgcggcattgtccgggcggatattgtcctcatcggtgtttcccgtacgtccaaaacgccgctttcacaatacctggcgcatcaccgctataaagttgcgaatgtgccgattgtgccggaagtggatccgccggaagaactttttcgtattccttccaaaaaatgtatcggtttaaaaattgatcctgatacattaaatcatatccggaaagaacggctgaaaacactcgggcttgatggttcggcaagttatgcgaccattgaacgcatcaaatacgaactggattattttaatcaggtagcggagcggcttggctgcaaagtgatcgatgtcaccaacaaagcggtcgaagaaacggcaaatattattatggatgaaatgagaaagtaaaagcggtcaaggttcgagaagcgcatgcctttttgcggcatcggccggatgaaaataaatccaattgaaacgggggaagcaggctgaaacggtctttgcttccacccgtttttttaaaatttttcttttgaaaaaaacgaggcatatttttttctgtttttcagtatttatttatagtcaaaatggagcaagtgtactataataaaaaattgtgataaaaatgtatgatacgggtttagagtaagcttttaaggaataaactatttatgagtaaatgtcaagtctgaatttgaataaatttcgacagggccaaaaaaattatgggaagaagcgcaaaacatgcaggattctgcggagcaatgtagaatattttaggatgaaaagaaaaacagcaaacgaataagcattgccgtatcccggatgaaatgctgttgaataaaggtggagcagaagggattgtttgatgacagggatgattccaaatgaaaaaattgatgagatccgccggtcttccgatattgtggaggtcgtgagcgaatatgtacagctcaaaaagcagggccgcaattatttcggcctgtgcccgttccacggtgagcatacgccgtcattttccgtatccccagataagcagatttttcactgctttggatgcggcgcaggcggcaatgtatttacttttctcatggatatcgaaggcatctcttttcaggaagcggcagagaaactggcacaaaaagcgcatatcgagcttggcgtcgttttacggcacgaagagcagaaaaacatcgatccgaagcgccggcagatgctggaagcgcacgaactgctgcaaaaattataccaccatttgcttttgcatacaaaagaaggagaacctgcgctaaagtacctgcgcgggcgtggatttacagacgaagcaatcgaaaagttcgggatcggatatgcgctgcctgcctgggattttgccgccaatatgctacaaaagcgcggttttcccctttccgtgctggaagaaagcgggcttgtcatccgcaatgaaaaggacggcaaatatttcgaccgtttcagggaccggattatgtttccgatcatggatgaaaagggaaacatggtcgcatttgccggaagagcggtccggaaacaggaacacccgaaatatttaaacagccctgagacgccgctttttaataaaagcaagctgctttttaacctgaaccgggcaagagggccgatccgcaaaaaacagcaggcagtcattttcgaaggctatgcggacgtgatctccgccgaccgggctggcgttgaaaacggtattgccacaatgggcacttcgattacaccggaacacgtccggatgataaaaaggctcacggacggcgttgtcatttgctacgattcggaccaggccggcctcacagctgctttccgtgcggggaaaatgctcagtgaaaacggctgtgaagtgcgggttgcgcaaatgccggatgggctggaccctgatgactacataaaccagcatggcggagaaaagttccgcatggatgtaataggggccagcctgacttttatggcttttaaaatgcaatatttccgcatgaataaaaatctccaaaatgaaggagaaaagctggcgtatatagaagaagtcattcaggaaattgccaaactggagaatccggtggagaaagacctttacttgcgccagctgtccgaagaattttcgttgtctttggacgccctgaaagagcaggaaaggcaatacggttcccgtgaaaccgggacccggaagagaagccgccctgcagagaatccggtgcctgcacatgaggaagcccggatgctccctgccaatatgaccgcagagagaaggctgctttggcatatgctgcgggacggggaaattgcctataaagtgaaagatttccttggcgaaaacagcttttacggggatgaacaccaggcaatttttacttacctgcttggctggtacgaagaagggaatccgcctgatacgagcgctttcctgtcttatttgcccgatgcaaaactgcagcggattgctgccgaaatcgaaatgatgacggtaggcggggagctgacggatgaggaattggaagattatgtgcaatatgtgctaaaacaccagaagttgctgcgcattcaggaaaaactgagggcacaaaaagatgccgaacggcagaatgatttccaaaaagcgctgcaattggcgggtgaaattgtggcactgagaaagtctatgacttgaaatctctgctttttataaatgatcaagttgctgttggatcattgaaagtgttgaaattgtcggaaggaggggaacatatggctgaaaagtcagcacgttccaaagaagtagaagaaagtgagtttacagtagaaaaagcaaaagagcaactcgttgaacgcgggaaaaagcgggggtttctcacttatgataccatttccgaaaaactcggccattttgatttaacatccgatcagatggatgaattttatgaatcgctcggtgaacaaggaatcgatgtgacagatgacaccagcgacgaggatgccccttcccatctcgaactggaaaaagagaatgacgaagagtttgacctgaatgatttgagtgttcccccgggtgtgaaaatcaatgatccggtacgcatgtacttgaaagaaatcgggcgggtcgaccttctttccgcagacgaagaaatcgaactggccaaaagaatcgagcagggcgatgaagaagcaaaacgccggctcgctgaagccaacttgcgccttgttgtcagcattgcaaaacggtatgtcggccgtggcatgcagtttctggatttgatccaggaaggcaatatgggcctcatcaaggcggttgaaaaattcgattacaaaaaaggctacaaattcagcacctatgccacatggtggatccgccaggccatcacgcgcgcgattgcagaccaggcacggactatccggataccggtccatatggtggaaacgatcaataaactcatccgtgtgcaacggtcactgctccaggatttgggcagggaaccaacaccggaagaaattgctgaagaaatggatatttctccggataaagttcgggaaatcattaaaattgcccaggaaccggtttcacttgaaacgccgattggcgaagaagatgattcgcatcttggagactttattgaagaccaggatgccacatcaccttctgaccatgccgcttatgagctgctgaaagaacagctggaagatgtgcttgatacattgaccgacagggaagaaaatgtgctccgcctccggttcgggcttgatgacgggcgcactcggacacttgaagaagtcggcaaagtattcggtgtcacaagggaacgaatccggcaaattgaagcaaaggctttgcggaaactccgccatccaagcaggagcaaacgcctgaaagattttcttgaataagccggaaaaagaaacagacatggcgcttgtgcatctgtttttacaggcgccttgtttttagtttacttcctcgggaagtaaacttttttcttgcaaaaaaaggattttccgcccgcttgtcgaataggttacacaggatgtgttgaaaaatggacgataagagaaaacaaatcattgtcaacgaaattaaaatgtggaaagagaccaaaatgattccacaagaatactgcgattttctactcgcgatctatacggagggaaatgaggccaatacccgcaaacaaaacggcgcagggaaatccgttaaaaaacaagccgcggtttctgttttcattcttgccctcattgcaatcgctgtatttgtcatttattttactgaattacattttattttgcaaacgatgattttgacagcttttgtcggatgcttactttttctgggaattcattatgctaataaagaaattttttacccggttttctttgttggcgccgcgattattttgctgcttctcagtgtgtttttgaatgaaaaggtgtttggaaatcaccgctatactttatatttgctgctttttgtcaactgcgggttgtggcttatcgccggaaaggcatacaagctgctgtattttaccttatcggggtttctcggcctcgtcatcttgctggtctctatagtaatataatgtataattttcagttttcctgttgcccttttccggcccgcctgcaattgtatcactttattgaattttttgctgcttttattataatacaagatgaaagcgcattcaaccgttatttttaagtggaaaggctttctttcaaaagaattttcagttaaaatggaggagatgggcacggtaaatacgctggaaaagcggaaaaacaaggggggaatgcattgaaaagaaatcctgtaatcccatatgtgctgattatggtattcgggcttgcccttatcttttttctttccgtgaaagggatcggggatgcgaaagaagtggccaaagaaaaggagcatccgaagcaaaccgaaaccgcctcctcggaaaagtttgatccggagagctttgccaaaaagacttgcgtgacctgccacggaaataatttgcaaggcggggccgggccgaatctccacggcatcggcaagaaattgtccaaagataagattaaagatgtactcaggaacggcacgagcggcggtatgccagccggacttgtcgaagaagaccatattgatgaaatggcggactgggtatcaaagctaaaataaagggcaggttcaccgtacggggggcatcccccttttttttatggcaaaaagtggctacaatagaggtatcacatgtaaagtggtgaagaaatgaacagcgggaaactttcaagaaggcttgaatcggtggcggcttttattccggccggcactgtattggcagatatcgggtctgaccacgcttatttgcccgttttctgcgtgaaggacggtagcgtaacagcggcggtggccggagaagtggcggaagggccgtaccattcggcgcaaaagcaagtggaaaaagcagggctgactgaaaaaatcagcgtccggaaaggagacgggcttgagatcttggctccgggcgaagcgggatgcattacgattgccgggatgggcggcgcattaatcgcctctatcctcgatcgcggaaaagcaaaactaaacggcaaagaaacgctcatcctgcagccgaataccgggtcgcacattgtccgcggatggctggcggaaaacggatgggccgtcacaggagaagacattctcgaggaagacgggaaaatatacgaaattatcgcggcagagtacgcgggccgccatgtggtgctcacggaagcggaacgcctgatgggcccggttttaatcaaaaaccaaaatgaagctttccggaaaaaatggcgtaatgaaatcaaaaaatggcaatccgtgctcagccatctggagcaggcagacgcaagcccggaaattgaagaaaaaaagcgtgtatatcgccatttgattgctttggcagaggaggttttaacatgaagcatgcgaacgggcatgatgtcatccagctatttgagcagttcgcaccgaaaaagtttgcaatggacggggatccggtcgggctccaaatcgggcagttaaacgggccggtgaaaaatgtgctggtggcgcttgatgtgttggaagatgtggtggacgaagcgatcgaaaaggatgtccagctgattatcgcccaccatccttccgtttaccggccgttaaaaaacatggcgacagataccccccagggccggctgattgaaaaatgcatccgccacgggattgctgtctatgccgcccatacgaaccttgatatcgcagaagggggtgtaaacgatttgctggcggaggcgctcgggctccgcgatacggaagtattatcgcctctttatgaagacaaattgaggaaactggttgtttttgtcccggtatcccatgaagaagccgtaagaacggcgcttggaaatgccggtgcgggggcgatcgggaattatagccattgttctttctctgcccgcggtaccggccgttttctgccgggggaagggacaaacccgttcctcggggaagcgggaaagctcgaagcagcagatgaaacaaggattgaaacgatttatcccgtgtcgattgaaaaacaggtgctttctgcgatgcttgaggcgcacccgtatgaagaggttgcctatgatatttatcgggtcttaaatgaaggccggaagtatgggctcggccggatcggcgaaatcgaacgggaaatggcactgcgggaatttgcggaacatgttaaaaaagcgctcgaagttccggcattgcgcgtcgtcggaaatctcgacgaaaaagtgaaaaaagtagctgttctcggcggagacggcaacaaatattttgctgaggcaaaaaaggcgggggccgatgtgttcgtcaccggggatttttattaccataacgcccacgatgcactggcgctcgggctgaatgttgtagaccccggacataacgtggagaaggtgatgaaaaaaggggtcgcggcttatatgcagaaagcatgcagggagcatcagctcgatgtccgctttattgcatccgaagtgaacacagacccgtttcagtttctttaaaaaacgcccgggccgctcgaagtagggaaaaagacggccttttttaacccgggtcccgttatcctaaaaagattgcgatagctcattttccttcttttggacggggccccgttgcatctcgtatggactaaaaatacacaccaattgattttcatgatgctgcattttttccagcatggatgatgaaaggcaaaagggcggagtccggtggggatccgcccttttgcttatattccattccggccggaagcgtttcaaccaggtttcaagctttttggccggaagaacggtgcggcgctttcactttcggcaaaattttggttaacggtacgttccgctttcgttcccaggttgattcgtcttccgggtcaaatttttcaagaaatgctatgacttcacgtacgatcggcgtcggtgttgatgcccctgccgttacggcaactttttgtacaccttcaagccacgccagctcaatttcttcgacatcggcaatccggtatgctttcgtgccggcaatttcttctgatacttgggcgaggcggtttgaattgttgctgcgcgggtcgccgactacaagcagcaaatcagcctccccggcctgcctggcaacggcttcctggcgaatttgcgtcgcatggcaaatttcattgtacgtttctgcatgcggatatttcttttggataagttccattaaatccgccacgtcccattggctcatcgtcgtctggtttgttacaatgattttatcattgcggatatcgagggctttaacgtctgcttccgtttcgacgagatggacaatcgcaggtgcgacaccggctgccccctcgggttccggatggccttttttaccgatataaatcacatcatagccttctttttctttttcacggattaaatcatgggttttcgttacatccgggcatgtggcatcaatggccgtcaagccttttttccgggcaagttcgcgcacttcgggggagacgccgtgcgcggtaaaaataacggtgcctttctccaccttttcgagaatttctttgcggtttttgccgtcgagcgtaaggatcccgtcttctttaaaggcatcagtcacatgctggttgtggacgatcatgccaagaatatagatgggacgcggcaaagttttatccattgcggcgttgcgggcaatgaccattgcgtcaacaacgccgtagcagtaaccccggggggaaattttcagcacttccatcgcgatcctcctaacagggtgccggaacaccggcatccgggctgggaaatgagtctattacatttgtattatatcggaatgcggcaaagaatacaaaacgggtttttgcacagccggccgtgcccgaaatatggcgcgctcccggaaggatggaaaagcagaggctaatgccagcttttaatagaacgaaccgtctatacgcgggtgcaaacttttggtgcgccagataccgaatggttcccggccacagaaaaaaccgtctgcacacgggtacaaacggttttggcgccttaaataaacaatttcggcacggagactcctttttccgggcgtttttcgtcatttttgctttctgcggcttgagatgcgggacgctccgcttgccggttgctttttttctcttttgctggcgcaggttttttgtctttgctgcttaattcgcgattttcctgctcatcctgctcatcctcattcggggcatttttcaggccgcggtacagtttccacatcgctggcagatttttgacgagcgggccgacctgctgaatctgctggatcatcgggccgacctgctgcgcggtttttaagacattttgtgtattgtttaaaaacgaactgatcgaagaaggatttgcgatggatttgaaaagcgatccgcctcccccggcggcaccccgctggaaggcagctgccgggttggcggctgcgctttgtccgcccctttggaacagtctggataaaagccctccgccccgtcctgcagttgcgcctgctctacccggaaatcccggcatttgccctccggctctgaattgcccgggcatgcccggcccgcccaggcggttcccggcaaacggatttcgctgcattccgccgaacggggacggactttgccggccgaaaaagggcgacatatttcttggcggcatccatttgaccccctttctgtttggctttttcgttcaatattacaatatgcaggccaaacggaaacgtctggcatgcaaaaaaagtttctttctgcctgtaaacggcacaaaaatttccatttgcatacgggggcatgcggaaattggcatttttcgcggatgtcgattataataacaagacgttctgctgcatgagagaaggagtggaaacatgaacggaacaaaatgggaagatttcggttttaaatcatttatcgaaaaagcgatcgaacataaaggctttgccgaaccgacggaaatacagcgaaaaatgattccgcttgttttgcggggggaaagcgctatcggacagtcgcagacgggaacggggaaaacacatgcttatgtgttgccgcttttgcaaaaagcagacccgtctcttgcggaagtccaggcggtgattacggccccgacgcgggaactggcggcacagatataccatgaaatccaggaaattttaaaatgggaagaaacaggccgtcttaccgctaaactatttatcggcgggacggacaagcagcgggatatcagcaaactgaaaaaacaaccgcaaattgtagttggcacaccgggcagggtaaatgatcttgtgaaagaacaggcgttatttgtccatacagcgaaaacgtttgttgtcgatgaagcggatattatgctcgatatgggctttatcgtggatgtcgaccaaatcgcggggaggatgtctgaaaaactgcaaatgctcgtgttttcggcaaccattcccgaaaaattaaagccgtttttaaaaaagtacatggaaaatccgaaattcgagcaggtagcgccgcgccaaatcgcagcgaaaaaaattgaacatattttgatcccaaaacgcgcgcgggagaaaatggacgtgttgcatgatgtcctcgaggcgtttaacccgtacttggcgattgtatttgcaaacacaaaagcgatggtggatgaaattgcagcagggctctcagcaaaagggatgaaaacggcccgcatccacggagacctctcgccgcgggaacgggcgaaaacgatgaaacaaatcaaaaacctggaataccggtacatcattgccactgatttggccgcgcgcgggattgatatcgaaggggtcagccatgttgtaaactacgagctgccaaaagatttaacgttttacgtccatcgcgccggcagaacggcccgcgccgatctgtcgggcatatgcgcgaccatttacgaaccttccgatgagtttgccctcacccagcttgagaaaatggggattgcatttctctaccgcgatgtgcgccgcggcgaatgggtggaactgggcgatcggaaccgccgcaaaaagcgggtaaaaaaggcggatcaaacggagactgcggcgagaaaggcaatcggcaggccgaaaaaagtgaagccgggctacaaaaagaaaatggaacggcagatcgaaatgctgaaaaaacggcaaaggaaattgcaaaaacggaaataaaaggggagaaacagcatgcttaaaattggttcacatgtctcgatgagcggcaaaaaaatgctgcttgcgtcaagtgaagaggcggtttcatacggcgccaacacattcatgatttatacgggcgcaccgcaaaatacaaggcggaagaaaattgaggacttgaacattgaagccggccttgcccatatgaaagaacatggcatagaggagattgtcgtccatgcgccgtatatcatcaatatcggcaacacaacaaatcctgcgacatttgaactcggtgtccgttttttgcggtcggaaattgagcggacggaggcgatcggagcgaagcagatcgttttgcacccgggcgcccatgttggtgcagggccggaaaaagcgatcaagaaaatcattgaagggctgaatgaggtgcttgttccggagcaaaccgtccagattgcgcttgaaacgatggccggcaaaggatccgaatgcggcaggacgtttgaggaactggcggaaattatagacggcgtcaaatacaatgacaagctttccgtttgctttgatacttgccatacccatgatgccggctatgatgtgaaaaaccggtttgatgaagtgctggatgaatttgaccggatcatcggcattggccgcctgaaagtattgcatgtcaatgacagcaaaaatgaagccggctcgcacaaagaccggcatgagaatatcgggtttggccatatcggatttgaagcccttgactatatcgtgcatcacccggcgctttctgacatcccgaaaattttggaaaccccttatgtcggcgaagacaaaaagaaccgcaagccgccgtacaaatacgaaattgccatgcttagaaacaggaaatttgacgaaaatctgctggccaaaattgtggagcagcccgcttgaatcctggtcaggttttaaagccgctgaaacaaaacggtgagacactacattcttagtgtctcatcgttttttgcatctggacagtttcagtggttttcgtttggccgggattttttaaaaataaacctccatttgcaaaatgaaatataactgtaatctatttatcaaaccatcaatgctataatcagaaatatcaatagattaatagaacggaatctacacataatgagaaaaagccgatacatagcaatggaggcgttaaggtgaataggaagtttttgtcgttaaccgctgctgcagtgatcgcaggcagcgctttcgtcccgcttagcaaagcaaatgcagaaaccgctgtcaagagcattcaaaacgaggagtcggccgttaaggaaagcatttccggcaagcaaaacgagattgcgaagatcgcagaaaacgcgaagcagtttcagtcggatatggaaaaaatttcggctaagatccgccaaaccaatcagaaaatcagtgaaaaaacgcaagaagtgtcagagacgaaagacgaggtcgcatcgttaaatgaaaaaatgaaagaaacgcaaaaaagaatagaagagcgcaacaacgtgcttgcccggcgtgcgcgtgacattcaacaaaaaggcggagcggatagttatctgaatgtgctgcttgaatccagcagcctgagcgattttgtcagccgagcgcaagcgttaacaacgtttgtccaagcagaccgcgccattttaaaagcgcaggaaaaagacaacaaaacattaaatacagcaaaagctgaagtggaaaagaagcttcagaaagtgcagtcggatttagctgagcttgaggagttgaaagaagcaaacaaataccagcttgcggaccagaaaagcttagaagcggcgctgaaggagcaaaaacaagctgctgcagctgaattggcgaagctgaaagacaaggaagcttccttaaacgcgcaggaaaaagcagcgctcgctgaactggaaagcaaagagaccgagaccgcaccatctgctactgctgcaaaatcttccgcgcctcaggaatcgaagcaggatgattccgcttctaccggcacgagcaccggaagagacgattcaaatggagaaactgcggcacatacacagaaggaaaagacaaagtccggatcccgcgcaaaacatgtggcgcgcgtaccttccttttctgatgacggcagcgcttcaaacaacggttccggaacggttgaaaaagcgatcagcgccggttcagctttaatcgggcacacttcctataaaatgggcggcggaagaacgaaaagcgacattgcaaacgggctttttgactgctcctcatttgttcattgggcctacgcacaggcaggcgtgaacctgggtggctccggtgcgaatacggatacgcttgcagggcttgggcaagcggtcagtgcttcgcatatgaaacggggagacctggtctttttcaatacttataagtacaacggccatgtgggcatttacctgggcggcggcaaatttctcgattgcaatagttcagatggcgtttccatcgacaccatgagcagcggttactggaaacagtgctttaatggcgttgtcaggcgcgtagtgaaataaggaagaaccggccgaaaagctttttccggccggttctttttctattttgccaataagacaaacacccggttgatttcttttgcggtgagcgggcttgtaatttttgcaatgtctttcagtgctttgctgcgggcctcgtcatcaaagatgtccaactgttttccccgcacataatccgcgattttttccgcatcttcgcggctgattttcacgttaaactgccgcgcgtatttaaaaagttccgcgccggtaatgatattcaccttataattgaccatattttgaatcagtttcaatatccatcactctccccgcttcatgtatatgcgggccgggaagaaatgtttcagatgcttatggaaggggatattgccgcggaggaagaaaagcgataagaaggcggcaattaccggcatttccacgtgaacccctccgcgctttacaatctttcggaaagaaggtataatgtttaaatcggaatgattctgattgaggagtttgcgtatggaagaatatgttgtagaagtttctggcctctctttccgttatgaccggcagaatgtgctggaacagatcgatttaaacataccaaagggagcgtttctcggcatcattggcccgaacggttccggaaaatcaaccctgctaaagctcatgctcgggctgttaaaaccgcaggaaggggaaatccgccttttcggcacgccgctcagccgctttaaagactggagccggatcggttttgtctcgcaaaaagccaatgcatttaatactggttatcctgcgaccgttttagaagtggtcgaaagcggcctggtgaaaaaaaccggcctgttccgtttccttggccccggcgccagaaaagaagcaatggaagcgatccgctcagtcgggatggaggcgtacgcccatcaaaatattggcgagctaagtggcggccagcagcagcgtgtgtttatcgcgcgggccattgtcagcaagccggagattttgatgctggatgagccgacagttggtgtggaccagcgccatgtccggtctttttacgaaatgctggagcagctgaacagggaatggggcattaccctgattcttgtcacacatgatatcggcgccgtttccgacaaagtgacgcatgttgcatgcttgaaccagcatttatatttccatggcgacatccacgcgtttcagcagttggatgaagaaaaacgttcatcctggtatgcccacgatgtccggttgctggcgcatgaacatgggtgagaaggagaaaccgaatgattgctgcactttttcattatcattttttacaaaatacatttttggccggcattttaatcggcctgattgcccctttgatcggtagttttattgtcgtacgccgtttgtcgctgattgcggatgcgctcagccatgtcacattgtccgggattgcgatcagcctgtttttaagcagcaagctttctattcttgccgggttgaacccgctttatattggcaccggcttttccgtgctcggatccgtgctgatcgagcggttgcgcggggtttaccggcattatgaagaacttgcgattccgattatcatgtcgggcgggattggcatcgggctgatctttatttctgtggccggagggtataatgtagatttgatgaattacctgttcggcagcgtaagcgcggtaagccaggctgatctttggctcattctggggattgccgtcattgtggcggctgtgatccttttgctgtataaggaacttttcctgctttcttttgatgaagaatatgcaaaagtgtccggtattcctgcgaaaacgatccatttgctgtttatggtgctgattgcgcttgtgatttcggctgcgatgcggatcgtggggattatgcttgtatccgcgctgattacgctcccggtagcggccagcatccgcatcagccggggatttaaacagaccattttgttttccgttctttttggcgaaatttccgttttgggcgggctggttacggcattttatctgaatttgccgcccggtggtacaattgtggtgatttccatcgtcattttgcttttggcggtttatatgaaacgattccggcccggtgccggtttgaacaaaaagaaggtgtgaacatgcttttggatgaggcaattgaaatcttgaaggaaaacggctataagcatacaggaaaaagggaaaaaatgctcgatttgttttcggagagcaataagtatttgacggcaaaagacgtgctcgaatggatgaaagatgcgtatccgggcctcagttttgatacgatctacaggaatttatcgctttttgctgaacttggcatactggaagtgacagagctgtccggtgaaaagcatttccgtttcaaatgctcgacaaaccaccaccatcaccattttatttgcctggcgtgcgggaagacgaaagaaatcccggattgcccgatgccaatggtgagcggtttggaagggtatgccatttccggccataagtttgaaatttacggcacgtgcccggaatgcatggcagatgaaacgcggcaaaatatttaacaaaccctgcttccggcagggtttgtttttgctatataagttgaacgaatgtgttgccagaatccatatcgatcctgatcgtagtagatgttggcgcgaaaaactgaagttcattttatgattttggatatttttcaagacgccttccgggaaaaataacccgggcgcaggcacgcgggtcaccgcaaaaagctatccgcaacccagcctgtcccttacagaaacccggataagcccttaatcgcgtgcggagcggctggactgggtgatccagcgtctgacccagtcatccgcttctttccaatttttcacccggtatacattgtccgggacgggatcccggttgtatggggtgtcaaacagaaggacggggatgccgagcgtttgcgcaatggcggccgcattgtcatgtttgtcttccaaaaacaaatcaacgttgtacttttttgcggtttccactttgtgatgcgtgccgatcagctcgatatgatggtatttcagctgttgttttgtaaaccagtttttggtcacatcaaggagataggatgcgcgtgcgctgataaaatacagctcaaaccggtctgcccatttgtttaacacttcttttgccccttttgcaaccggggattttgcatagatcacaggctccgagcggataaaccagtcggcaaatgtcccggcaggaatatcgacgacatctgtgatctcatacttcgttaagtcttcatatttcaggtcaatgtgaaaggcatcgttaatgaacggaataagcgtttcaggatctgtcacagtcccgtcaatgtcaatgccgaaacggtattttttcaccatggtgcgcctccttttccgttttgaatgtgaagcgatcgtgccgcctgttgtccgggccaggcctggaagataaaagttgccgcgcatgaagaaacaccggcttgttttacgccggtgtttcggtcagacggggttcacgttttgcgcggcctgtttttggtaatacgcttcggcaagcatgtcgatttcttttttcaattcttctaccattttatcttccggcactttccgtatgattttccctttgcggaacaggaggccttccccgcgtgcaccggcgatcccaatatccgcttctcttgcttcaccggggccgttgacggcgcagccgaggacggaaactttaatcggcgcttttatggtctgtaaatattcttcgacttcgtttgcaatgctgattaaatcgatcgcaatccggccgcaagtcgggcatgaaacgagcgtcggggcattggaggaaagcccgaatattttcagcagttcacgcgcgactttcacttcttccaccgggtcggcgcttaaagaaatgcggagcgtgttgccgattcccatatttaaaagcgtcccaatcccggcggcacttttgatggtgccggaaaacagcgtcccggattcagtaataccgagatggagcgggtagtcaaatgtccgggccgctttctcgtacgcttcgatggcaaggcggacatccgaggctttcatcgaaacgataatgtcgtgaaaatccaggtcttccagaatccggatatggtgcagggcgctttcgaccatgccgtctgctgtcgggtatccgtatttttgcaaaattggtttttcaaggcttccagcattgacgccgatccggatcggaatgccgcgctcttttgccgctttcacgaccgcttcgactttttcgcgcttgccgatattacccgggttaatccggattttatcgacgccgccttcaattgcgattaacgcaagccggtaatcaaagtggatatccgcgacaagcgggatatggattcttttttttatgtcgggaatagcccttgccgcccgttcatccgggacggcaacgcgcacgatctggcagcctgcttcttcaagccgctcaatctggcggacagttgcatcgacatcatgtgttttcgtcgtcgtcatactttgaatgaataattcattgctgcccccgatcgtcaagttacctaccttgacagggcgcgtttttgtacggtgtatgatctcacccaaggatattcgctcctttaatgatctatcagtccataaacattttaccaacttacattttaccaatttactgccccgattgacaagccatactccggtttttaccgggattcgccgtaaatgggaaaccggtatgtttgtccaatttggatgtcttccggtgcaattccgccgtttagtttgctgaaatcgcggatcactttttcaatcgaaggcgccgtcccgcctgatatttttttgacaatcgtaagcaccgtgtcaccggaatggaccttggctgtgacatacggaccgtgggttgtttcaggttgtatggcaacgtttttttcggttgtttctttagcattcgtcgggattgtgcctgcgtggagatcgtagtagatgctgtaagagataagggcaacgataaagagcgcaaatatttttttcaacatggacattccctccttttatgagtgctaccagtatatgccggtatgctgtaattagaacccgggatgattctcaaaaatgcaggcgaaaaatttgccatttatcaatcggttttggtacattaaatatgacaaatctttgaatcttttcggttcaaaacactacataaaggaggaataaagatatgacgtacactttaccgcaattgccgtatgcgtatgatgccctggagccttatattgacaaggaaacgatgaacatccaccatacgaagcaccataatacttatgtcaccaatttgaacaaagcgttggaaggccatgacgaccttgcttccaaatccgttgaggacttaatttcggatttgaatgcggttccggaagaaatccgtacagcggttcgcaacaacggcgggggacatgccaaccattcgctgttctggacgttgctttcgccaaatggcggcggcgaacctaaaggcgccctgcttgacgcgatcaacagcaaattcggcagctttgaaaaattcaaagaacaatttgcagcggctgcagcaggccgtttcggttccggctgggcatggcttgttgtcaataacggcgagcttgaaattacaagcaccccgaaccaagacaacccgctttccgaaggcaaaaaaccggttcttggccttgatgtttgggaacatgcttactacttgaaataccaaaaccgccgtccagaatatatttctgcattctggaatgtcgtgaactgggacgaagtggaaaaactgtacgaagcagcgaaataatcgcgatccatttaaaaaagggcgtgccgcgccatttgcgtgcacgccctttttgcatgcgcccgtgcataaacgcccccgtttttcaaaacaatataggggaatggggggagttttgatttatgaagcatgtgcaaaaatggttcggagatatagaactgtcaaaagatctgctgctgctgcttgcgatcggcgggctttattctttaagcatttctctgtccaattctttcgttaacatatatttatggaagcagacagggaagtacatagatctggcggtatataatttatcggttgttatcctgcagccgctcacttttatcatcgcgggaagatgggcgaaaaaagtggacagggtcatggtgttcaggatcggggttgcctttttggcgctgttttatttaagcgtgctgttttcgcgggggcatgccggcgattttatcgttttgcttggcgggctgctcgggatcggctatggcttttactggctcgcctataacgtgctgacgtttgaaattacggagcccgagacgagggatttttttaacggctttatgggggcattcggatccatcggcggcatggccggaccgtttgccgccgggctgatcatttcagcgatcgggaaaagcggttatacggtcgtttttgcgctctccctcatcctgtttgctcttgccgtcgtcctcagtttttttattgcaccacgacctgcacacggccgttatttgtttaagcaaatcgtaaaggaacggcatcgcaacccgaattggaaacggattacaagcgcccattttgttcaaggtttaagggatggcacgtttgtgtttatgatttccgttttcgtgttcctttccacggggagcgagctttctctcggcacgttcgggttgatcaattcctgcctgcagtttctcgggtacacgctcgttgcccgttatataaaaatcaaacaccgccagcgctccatttttttaggcggactgcttctgtatgcggccgtgtttttgtttatttttgaagtcacctatccgagaatgctgctttatgccgcaacgattgcgattgcttacccgcttctgcttgtcccatataattcgatgacatacgatgtgatcggcagggcatggaaagcagcggaagcacggattgagtatgttgtcgtgcttgaaatatttaccaatgccggcagagtcgcttcgattttgcttttcattgcagccgtcacttttttcaacagccaggtaagcatccgcgtgctgatgcttgtgattggggcagggcatttatgcatttcgctttttacaaggaatatccggattggggatatgtaaggccgccgtttccaaaaatggcggtattttttatagccatgtccgcactttttcgctaaaatggaatgtatagccgatggcgaagggaggagcagaaaaaggttgaagaaaaagaagcgaaaaaagcggtcgcatattccatttagaatgaacatgctgttctttgctgtttttgtgcttttttcggtcttagtcgtgcgtctgggcatcgtgcagattgtctacggccaggattacaaaaaagaacttgaacagacggaagacaagacgatccatacttctgttccaagaggaagaattcttgaccggaactataaagtgattgtgggcaataaagcgctgaaggcgatcacatatacgagaacccaggcggatgacaacgggaaaatgctgaaagtggcaaggaaactcggggaaatcatcaaagtgccggatgcggatgtgaaacggctaacggaccgggataaaaaagacttttggatcctgacccatccgaaagcggcaaaacagctcgtttccaaagcggaacaggcaaagctcgacaacgacagcgacaaaatatacaagttgcagctgaatcggattacgaaacaggatctggattcactgtcgcgggatgatctcaatgtgctcgcgatctacagcaaaatgtcggccggctatgtgctgtccccgcaaattatcaaaaacacggacgtgacgaataaagagtatgcgactgtgagcgagaatctttcagcgctgccgggcgtggatattacaaccgactgggagcggaactatgtgttcaaagaggcaaacagcaacgattcggttttggggtcaatccttggcgatgtgacaaccgaaaaagaaggcctgcctgccgataaggaacagtactacacggcccgcggatacagccgcaatgaccgcgtcgggaaaagttacattgaacagcagtatgaagatgtcttaaacggcgaaaaagaaaaagtggaagcgaagcaggataaaaaaggaaatgtcatctcttcaaaagtaatcagcaaagggaagccgggcagcgaccttgttttgtctgttgacattgacctgcaaagagaagttgaaaaaattattaccgatgaaatcaaagcggcccgcgcaagcaatccgcttgttgaccgtgcctttgtcaccgttatgaacccgaataccggtgaagtgctgacaatggccggcaagcaggtggtcacaaaaaacgggtctgcgaaaatcaaggactttgcactcgggaatatgacaactgcttatccttcgggttctgcagtgaaaggtgcgactgttttgaccgggtatcagaccggggccatttcgcccgggagtgtatttgtcgaccagccgctccatttcgccagcacccctgtgaaaaaatcgtgggtgacgtctggttttggtgcgattaacgacttaaaggccctgcaggtttcatcaaacgtatatatgttccggacggtcatggcgatcggcgggcagcacaattatgtaccgaatggctcgcttaatattgacaaaatgaaaacgatccggacattgcgcaaatattttgcccaattcgggctaggtgttaaaaccggtattgatcttccgggtgaagtcggcggctatcaaacggaagtcccgccgaacagcgggaacgtgctcgactttgggatcgggcagtttgacacgtatactgcgcttcagctctgccagtatgtttccacgattgcaaacggcggttatcgcgtgcagccgcatattgcgaaggaaatccgtgaaccgagcccggacggcaagacactcgggcctgtcgaaaaagaaatcggcacgacggtcttaaaccgtgtggatatgaaggagtcatacatcaaccgcgtcaaacaaggtttttataacgtggtgaacgttccccacggaacagcttacgggcggattgattccagtctgaaagtggcagggaaaaccgggacggcacaggctgtttatggcggtgaactggtggaaaaatacgatgcggccggaagggcacatccttccatttggtcagatgcatggaattccacctttgtcggttatgcgccttacaatcacccggaaattgccatttcggttgttgtgccatggtcttacatgggaggcgcatccgacccgcacacaaatttaaagattgcgaaccgtgtgtttaaagcttattttaacctgaagaaaaaagaagaaagccatgctgccaacacggccgtaccaacagccgaaaacggggcaggcggttcgaactaatggctgcgatcaaaaacggataacggggtttcccgctatccgttttctattccatggcacccgtaatgatgcgcttcacttcgtttacagggagggcggactgccttgcaatctgttcgaatgaaagaccttgccggaacaaagcgagcacctggttttttacaatttcattgaccggcatcctttcgccggacgaatccggaagaagcgggtcggctccaggcgccatgaattcttcttcgagcgtctgtaatctttttttgatctggtacgtttcctggaaaaattttaaagacaaatcttccagttcctgttctaccagatgcacgcggtcctggcggaaaaacgaaataagaaacaataccacagaaagcgccagtaacaccatcagcgtcataaccatccatttctctcctttttcattgcaaagtactattgttagttatatcacgattttccggtgaagtgtaccgcctttctggcaagagggggcgaaatcgtgcaagaaaagggggagcggcggacttgcccccattcaagtgaaaatttcacctataccggcagccggcgggaagaacggttttgcccgaaaaaacatactggcaatcgtccgtgaaaaatgctatgatagataagtcgtatgcacgatcgattgagaaagatggagggatgaaacatgcgtgtaaacattacactggcttgcacggaatgcggtgagcgtaactatattacaacgaaaaataaacgtacgaccccggaccgtattgaattgaaaaaatattgcccgcgggacaaacgtgcaaccgtacatcgcgaaacaaagtaaacagcaggcgttttcctgctgttttttcttttgccgggacttacatataaaatgaattgaagtttttacattgaaacaaggtcatccatttgcataggtttctttttgcagccggcaacaaagtagcgatgtttcgttcattttatatagcggataatttttctcccggcaggaaaaatagaaatgagttgcggaaaatttttttgggggaggaatcgccatgaacagatggctgaagtggatggcggtactgcttctgttttcagcagcttaccggaaccgttaccgagtattaaacactgtatttgggtacggccctgcgagaaaattggcggtcacggcagcaatgcggattcccggattgcggtcacgcgtcatgggccaggtttttcaataacggcgaaaaaagggcgggtgtaaaaggccaaacgctttacactccgctctttttttcgatatagttaggataaaatggatggaaaaaggcaggggaaatcgtgaacagcagggcagatgttttgttttgggcaatcagccgccattttgtcgtggaaaatgagtaccggatcatgtttttgagtgaaaaccgggatgaaatgtggcttgccaatccaaaaaagaagaatttgccgcttgtgcgccttttgcggtatgacatcgactggggcaactggttgtaccgcgacatccgtgattgttgcgcacaggctgaagatttatgcaaacaaataagacggcttgctccgcgcgtactcaatatttatgtgagtgcgtatgcgccggttgacgattatgaaatttatttggatgaaccgatgcatattaatggcggaaaaacggaactccacagcgtattgattgaaggggagaatcctgatcccgggatcagcaagctgcgtcagtttacggaaggccggcttgcgattgcgcccgaaaccatgggtggggacccctatgcattacagcggatggtgttcgcagccgaggcgcaacgggaagaggaggaacggcagctgtttgatgcgggcaggccgttttttacatacgtctttctggccgtacagattgccgtgtttattatcatgtcgcttaccggcgggacgcagaatacgcaaaacctgattcgtttcggcgccaagtacaacccgctgattatggaagggcaatattggcggctgattacgccggtttttattcacatcgggatcatgcacctttttatgaattcgctctctttatattacatcgggccgcttgtcgaacggatttacggtaaggcgcgttttgccctgatttatttgttcgccgggtttacaggctgcctggccagcttcctgttttcgccaagcctttctgccggcgcaagcggtgcgatttttggcttgtttggcgctttgctttacatcgggacggcttaccgcgatctttttttccggacaatgggatcgagtgtcattacgctcatcatcattaatctcgttttcggcttctccgtttccggcattgacaatttcgggcatcttggcgggcttttcggcggttttctcgcagcatgcatcgtccactttccgaaacggaagcgcatcggtgtacagcttccggctcttcttcttgccgctttcctcgtttatatgggcctgcgcggcgtctaataaagtatgccccccgtttcggttccggcccgcttctttggcgtgcaagcgcgggcctttcgggggacgaattctgccgggataaaaaattccctctttgagaccgcgggttgtcacggccattcttcaaaaaatgctccgggcatggtttcacagcgcacttccatgccgagcggccaaatgatccggcaaattgccgcaatttgatgcttgttagaagctgcacaatcgattatacttttctttggaacagatttttatcaaacgaaagctgggtcgaaatgagaacgctttatgatgtgcagcagcttttgaaaaaattcggcattattgtctatatcggggaccggcttgccgatctcgagctgatggaattggaactgagacaattgtaccaggcaagggtgctggaaaaccgcgaatacgaaaccgccctgttgatcatcaggcaggaaaaacggttggaaaaagagaaaaaaattgagggtgagcgaaatggctgagaaatggatcattggcattgatttggggggcaccaccacaaaactggcatttgtgaatgaagcaggcgatattttacacagatgggagatcccgactgtgacggctaaccagggggaagcgatccttccgaatatcgcaaaatcgattgaggacgaattggcccgggtaaagcgggagaaaaaagatatcacagggatcggcctcggcgtaccgggaccggttgatatggaagccggcgtgatctatgaaaccgtcaatatcggctgggcacagcattatccggctgccgggacattgcaaaaatggacggggttaaaagtggtgattgataatgatgcaaacgttgcggcactcggtgaaatgtggaagggtgccgggaaaggttccggggaaatggtcttcgttacgcttggcaccggtgtcggcggcggcatcattacaggcggcgacatcgtccacggtgtaaaaggggcggcaggcgaaattggccatattaccgttattccggaaggcggggcaaagtgtaactgcgggaaaaccggctgccttgaaacggtcgcttctgcaacaggcgtggtcaggacagccatggcgaaactggctgcatttagcagcgcgtctccgttaaaagatttgtatgcccaaagcggctcggtaaccgctaaagatgtgtttgattttgcgaaagcgggcgatgccctttcctgtgaaattgtggacgaaacggcaaaatacctcgggcttgcgctggcaagtgtggcaaatacgttaaatccggaaaaaatcgtgttagggggcggggtgtcaaaagcaggcgaaacgctcttaaacccagtgcgcgcttattttttgaaatacgcgttcaacacggtcggcaaatcgacaaaactggaacttgccacattgggaaacgatgctggcgtgctcggggcagcgtggttggcgttaaataaaatataaggaaagctccctctttcatgatacgcgctgattttgccatacgagaaacagcgatatctgaaaagaggagtttttttccagcctccgtactacaagggcggtatggccgttttgcgcaagtctttatgctgcagagaaaaagaaatggtttttttggactgaatcatctagagacgggcagcctgttgcaaacttgtgtgctagcgcgcactaagctttaagacaaattgaattacgggaacttgcttcggtttttggtgatgcaaagatgcaaaaaagcggcatggcgccgcttttttaagcattaagtaaaggtcgggtagcccgaatggatgacggtcatgatggcaaaccagccgaaaagggcaaaagaaatgataccgaaaataaatccgaggatatttttgtttttggccgcagtaatgaaaccaatcagtgacagaatggagacgagactgaaaataatgactgtacccatgacatcccccttataatgaaaaggcattcaattatctttattttacaaccagtctggtgatttgtcgagtaaatgaacaggcattttttgcggatgaaaacatgatacaataggacaggagggatacgaatgaaatggaaacaattgccggtcgggcccattcagacgaattgctatatcctgtggaatgacgaaaaagactgtttgatttttgaccccggcgctgaatttcacagacttcatgcttttatcggggaaaatgggctgaaaccgcacgcggtgcttttaacgcatgcccattttgaccatattggtgctcttgatgcagtgcgggatgcgtacaagatcccggcctatgtccatcaaaaggaagagatgtggcttggggatcccgggcaaaacgggtcctattttttcgggatgggagaaatcagcgcgcgcggggcggaaaagctgatcaccggggaagacatattgaaaatcggcgctttttcgcttcacgtgctggaaacaccgggccattcaccgggcagtgtttcgtactggctgcctgaacacaacattgttttttcaggggacgcccttttttccggcagcatcggacggactgatctaccgggtgggaatcacggcgttttgctggaaagcattcatacaaaattattggttttgcatccggacacgatcgtgctcccgggacacgggccgcagacaacgatcggggcggaaaaagactccaacccgtttttggagggataaaaaaaccggcatgcgctgccggtttttttagtgcaagaaaaaagcaagcagattttaagaggaacaggttattcgccgaagccgggtgtgagtataaacgtggtgtagtacgtaaagccggcgaagaaaatcgttaaatatgccccaaagatgtacatatacatgcgttcggacagtttcaagtagctgacaagcacaaagaaaccggtctgggccagaaacaataaagcggtttctttcatgccgccgagaaaaaacatgacggccattacaccagtccagaaacccagtacgcggtacatacgatccaaatgaaccaccccttctttttatgtccatcaagttttattataaaggaataaagaaggggtgtaaacacaaccggtgcttaattcgcaactttagcaactttcacatgataaatgcattcgctgcaatcatggagcatcgtttcctgctggttgatgtcgaaatcgtcaaacagtgcctcaaacaacccgtgaatataggcgacatgcatctcgcaaacatccgccgagtgatggattaattcccggaacggacagttgtatacatggtaatcgagttcgttcttgtctgttgtttccagcgtttcgatgcaatatccgtccacggtggacacgcttgcgagcacagataatttttcgttaaatgtcagctggtcttttgttttattcatgttttttaagatgttttcgatgatccgttttccgtactcccggccgatatctttcaaaaggcctgcatctgccagtttcattttgttgattgcttcaagcaaaatgttggacagcaatttgtattcacggtgcgggaaggagagttctaccacttgttcagagcttttatacagccttgccgggcgcccgcctttcccggttttgttcagttcagatgaaatcaccttaacatcttcgagcttggacaaatggagccttgccacattcggatgaatatgaaattcattggccacttcctggacggatacttcgctccgtttcttcagtacaaattggtaaatcgagtagcgggtcgggtcagaaagggcattgatcacttttaatgttggttccatatgaaacacctctatattttttatcctatttatattataaatgataacaacgccaaaatttgtgacaaaaatcacacacttttttgtcgctaagagaaaaaatagcgaaaaaatttttgttttaaagcaggaattttgaaagccgtgtcgaaatgagagaatatcccaaaaagaaaggtggtatgtgatggattatgtcagttgaaaaaattgcggaacttttgatcggacaggcggtaaaaaacaatgtgaccgatgtccatatcgttccgaaagaaaagcattaccatgtccagttccggcagtacggaaggctgtacccccaccgcaacctttccgcgaaagccggggaaaggctgatatcccatttgaaatttatgtcttccatggatatcagtgaaaaacggaaaccccaaagcgggtcgttcgccatgaatgttttgcagcagacgatctccttaagaatttcgacgctgccaacctctctttccaaagagagcctcgttattcggatcttgccccatgaagaaaaattccagctcagccaaatttcactttttccatcgagcacaaaaaaattaatggcgctgctcaaccattcgcatgggatgctgattttcagcggcccgactggaagcggcaagtctacgacgatgtatacgcttgttgagcactgcgcaaaacggtttttacggaatgtgattacactggaagaccctgttgaaaaacaaagcgactcgtttttgcaggtacaggtgaatgaaaaagcaggtattacttacagcacagggctgaaagcgattttgcgccatgatccggatattatcctggtgggggaaatccgtgatgccgaaacagcaagaattgcgatccgcgcatcactcaccggccatctcgtgctgacgacattgcatacgcgtgacgcaaagggcgcgatttacaggctgatggaatttggggtgagcatccacgaaatggagcagactttgctcgcagtcagcgcacagcggctgattacattgcgatgcccggtatgcggtgggatccgctgtccgcatgattcgcaagattgcccacgcagccgagaaaagcggcaaaccgcggtatatgagctgctgtacgggaaaaatttgcagcgagtgttgaaagaagcaaagggggaacaagtctactatcattatccgacactgaaagaatggctcagaaaggggattgtgcttggatacatttctgaagaagagtatcaccgctggattgccgaagaggaagaagcggataagcctcaaactgcaggggcgctttcttacccgggtcggtgaaatgctcgaaaacggatttccaattgcagatgctatcgattttctcgggcatgtggacggcgaactggatgcgcgttccatgaacaaacagctgcaaaacggaacaccgctccatgacgtgctgctgaaacaccggtttgatgccaatgcatgcatgcaaatttattttgccggacggcacggggagatggttgctgcccttaaagaggcgggcgcctacttattgaaaaaacatgaggatgcccttgccttttggaaactgatccgttatccgctcatattggcagccgcgctgtttatcgccacggcttttgtgagaaacgtgctgctgccgcaatttgaacatatgtatgtcgcaatggactacaaaccttcgcgaaatctccggctgttccttactatcatggaacaggccccgcatgttatcctggtttcaagtatttttctcttcctatttttcacactcttttttctctattttaaaagaaaaaaaccgctgatgcaggcggcatggctttcgcggctgccggtatcccgcttttactataccagctattacagccagtttttggcaagagaatggagctttatgctgaaaagcggtttttccgtctatgaaattttgcatgtcatggaatcgcaaaattttaagccgctttggcgcgatactgcaaaatatttgcgcgaaaaactgcttgctggtgagacgttctcccgggccctggcttctgtcccgtttatcgagccacagctggtcattttggtccgccacggggagaaaaacgggcgccttgatcaggagctctattattacagccaaattagcttgaaaagaatggaagagaaaatccaaagcctgttcgggctgattcaaccggttgtgtttattttcatcggtttctttttggtcgccatttatttgtcgatcatgctgccgatgttccagatgattgacgcggtttaaccggggaaggcgtgccggatggcggggcttcaagccttcccacaaaaaaagaaaggagaaattgtccatgtcttttatcaaaaatgaaaaagggtttacgctgatagaaatgctgattgttttgctcgtcattacggttctcttgtttttgatgattccgaacatttccaagcataccgatgcgatcaataataaaggctgcgatgcgttcattgcgatggtgcagggacaggtgcaggcgtatgaaatggaccacaatgaatatccgtcatccatcagccagttaaaagacggcggctatgtatcgaaaacgagctgcccgaatggaaacggagtgaacatcggggcggacgggaaggtaacggaggttgcaaagtgaagcggccaaaaaacgaagccggttttacctttccggaaatgctcgttgttttgttgattgtatccgtgatcaccgcccttgcgtttgccggttttaagccggtgaaacatacgatcgtcaaaaaaatgttcatcaaccagcttgaaaacgatttgtacttggcacaaacggacgcgatttctcgccagacgaacgtttacgtccaatttttccgccagagcaatatgtacgctattttcgaagcgaggaaaaatgcgacgattgtaaaaagaaggcttccggaaggcatcaaaatgttcgaaaacggcagctttcattcctatgcaattgggccggacgggaatgtcacccagttcggcacgctctatttccagtccggccaagaacaaatcaagctggttacgcatattggaagcgggcggttttatgtcgaagaatgaacggggctttacttttccggaagtcatcgctgcgtttgccgtattttgcctgatggcggcctgcctgttcccgccgtttctccatatgcttggtcaaatcaaagaggcaaaacaagagatggaggcagcccgttttttatacgaaaaaacggaggaatggatttttaccggaaaagtcgttgaaaaagaaaaaaaggcgggcggggccacatggacatttcaaatcaaagacaatggcagaaaggcatgtgtcaaacatgaacaaaacacgacttgcgtttcgctccagcaatgaaaaaggctttacgctgcttgaaagcgtgtgcgtactgcttctcgtcacttccttgttctcactttttcccctggcagtgaaaacattcgggacagccggggaagcattccggccggaagaagatgaagagtggaatctttttctcatgcagttgcgtaaagaaatccggataagcacctcgtgccaggcagcccaaaatactttgaaactgaacgaggcaggaaggacggttacgtatgaaccataccagaacagtctgcggcggagagtggacggtgaagggcatcaaattgtgcttcaaaatgtgcagtccatccaatttgcggcaacaggaaacggggtcaaagtggccgccgtttatccgaatggcgcggaaagaacagcggaaatgacctttctttcccgccatgcggttgatcccggccaatcggaaggcgttgcccgatgaacaggcaaaaagggtttattttgccagtggtgctgtttttggcgcttgccgcatgcagtatggtcatttcgggaacggacatttatctcggcgaaaagaaatatgccgtgctggtgaaggaatattatttgcggaataccatgtcgcttttcgccattagggaggcggcgcaaaaattggaaaaaggcgacaaaagcccgggggaactccgtttttcagacggaaaggtgtcttacagtatcaaacaggacggagatactgcagtgatttctttaactgcggaaaatgagagtggtgaaccgtttaaaagtacgatacgatataatcagacagaaaaaaaggtgtttcaatgggaggaacgatgaacaaaaggatctatttgaccgggtttatgggtgccggaaaaacgactgtcggccatgcgctcgcctcgctcttgggaagtagggcgacggacttggaccgctggattgaagaagaggaaggaatgccgcccgctgccattttcgctgtaaaaggagaagcctattttcgccggaaagaaacagagatgctgaaacgggccacatcgcttgcaggggtgatcatgacaggcgggggaattgtcatgcgggaagaaaacgtctgtctattaaaacgagacggcgtgacggtttttctggattgcgatccggaaatattggtttcacgcattcaaaatgacccctcaagacctgttgcagcaggaaggacaaaggaggagatcatctccctttataaaaaaaggcggccgttttacctttcttgtgccgatttggttattgatacgacgggaaaatcggtggcggaaattgttgcggaaatttccggccgcataaaaacggaagctttcgggtatactggcgcctgtaaggacggtggcgccaatgtcgacaaatgattatgtcaaattgctgacacaaacatggatgcagcatgtgagcacgccaaaaagcgagcggcagaaaaagcggaacgagaaaaaggaagagatgccgccttttgccgaaagatggttcggtatcctcccttattttttcctctttttcaaaagaaaacagtagaaagcaggcagccttttttgcgggctgcctgcttatataaacgcatcttttaaataaaagaggccaccgtttaggacatgaacggtaattttcggctcatactgttcctttagtgcctgtttttcaatttcatacgattccgggcactcttccatatcttcgtaaaaatggtccaacagcgcgagatcctggtgccaccgttttaccgcttcttccgcccaatgatgcggctctttcgccaggccctgccggatataatgttcaatccttttgacggcgctttttagcatgatgatcggcgtcagggtaaaacaataatccggaattttcggcgccagcgtccgctgctccaacaagtcctgaaaattttcagccattgtgccgtggatcaaattcaacccgatcgaacggaacacatctttttttaaatcacagcggtacgaaattttaacattcatcccaagccaagggtaaagcggcacctgtttctgcccgggatggacgtcttcaaacaggcggatatagcgggaaaactgctttgccgtctcgaaaatctggttcaggcgggggcttccaaaatggaccggctctcctttcaccgtatccggtgctttttcccggtccgtaatgaacgtgacggtcatcggattcgggatgccgcctgttttttcaagataggaccagtaaaacggccggttcattaacgctttatcgagttcaatggttaattgcaccgtcatccagccggggcggttttcaaccaatacagcgccgtttgcttcaaaaaagcgttcaagatattgatgtatttcttcctgcagcatccgcatgcccctcctctttccgtatcgcttccgcaaattcgatcatttgggtgagattttccattttgatgttcatttcgccttctgattgcgagttttggaagacatccagcagatggtcttccagttttccgaattcgagccgggtcagaatttcatcgagttccccgatcacccgctcaaacaaatggattttttcgtacaacagtttcagaatatgttcttcaaccgtatttttggtcgcaaagttgtaaatatgcacgtccttttcctggccgaggcggtggacgcgcccgatcctttgctcgagccgcatcgggttccacggcaggtcaaaattgatcatatggtggcaaaattgcaggttgatcccttcaccgcccgcttctgtcgcaatgagcacctgggcgtggttttcaaacagcttccgcatccagtcttttttgccgcgcttaaagccgccgcggaacgggacggatgaaatgccgtgttgttttaaaaaccattgcaggtaaagctgtgttgcccggtattccgtaaaaataatcactttatcatcaatgttttggatcagctcgagcgctttttccgcttttgaattggtttttaccgcttcaattttctggatcagcgcagcaacggtttcttctaaaacgggcgagggctgctccgtttttttcagcaggttttttaaggttacaaaaacggcttcccggctcgaacacgcctcgcgctgcagcgtcaacagcgaaaagccggcgcggctgtacgattcgctgccttgccggatcgtttgcagcgcgtcatacagttcgcgctcttctttactgaagtcaatcagcaccgtttcaacgcgccgttttgtccattccaccccggtgtttgtgcgccggttccggatcatcactttgctgaccagctcccgcaaatgttcgtcttccttcacctgcctgtccccttttttatattttttgctgaaattcgattcgctgcctaaatggcctggctttaaaagggagacaaggtggaagatttcatcgatccggttttgaatcggtgttgccgtcaaaagcaggcagaatttcttctttaagccttgaacaaaggcgtaattttttgtattcggattttttaacttatgcgcctcgtcaataataatcatgtcatactgctgcttgtaaatgatgtcacggtgcgggcttctttttgcggtgtcaatggaagagacaacacagtcatactgctcccacatataacttttcttttgcccgacagcggggatatggaatttgctgttcagttccgcgacccattgcgatacgagcgacgccggaactaaaatgagcactttttttgctagcccgcgaatcatatattcttttaaaataaggccggcttcaatcgtttttccaagcccgacttcatccgccaaaatggctttgccgttcattttttcaacgacctggcgggcaacctccagctggtgcgcaagcggtttgacattggccagatgctttggcgcctgcaatccttcaaattcaggaatgaccagccgtttttccatttccactgcaagcttataaagttcccattttccccacggcccgtcgtcctgatagcgttccatcaatcccgtttcccatgagcggtcaaattcaatgttgacttccatgctgcctgcactccttttccaatcgtccccgatcatcgttttcgatttcttacagccgctttttattttaaaaaattcaattgattttcagaatggtgtcatgatacgatgaaactgatcaagagtttttacaggttatacagggaaaaatcgtatcgaacagcctgcatcaggcattttaactttagtatgcccgattttgaactgaatattggcggatgagaataagaggagagactgcattttttgcagcgccgacggagcaagcggaaacgtgaatctctcaggcaaaaagactcttaatttgacgcatctctggagagcgcttcttttttcgggaagccaccaaaggggaaaaccgtttttcggtaaactttcaggtgcaaggacagggaatatttcgtgaagcaggcggaatattccctgtttttttgcccccggatccacgtccggataaaaaacaaaatggaggggtacgaatgccggaattaaaacggacgccattatatgatgtataccggaaatacggcgcaaaaacgaccgatttcggcggctgggaactgccggtgcaattttcgggcattaaagccgaacacgaagccgtccgtacgcgggcaggcctgtttgatgtttcgcatatgggcgaaatcctggtggaggggcctcaaagccttggcttccttcaaaaaatgatgacgaatgatgtgtccaaattgaagccgggtgctgcccaatatactgccatgtgcaatgaagccggcggcacagtcgatgatttgctggtttaccaattgggcgaaaaccggtatgggctcgtggtgaatgccgccaatacggaaaaagattacaaatggcttgtttcacaccggacggaggatgtttccataacggacatcagcgcatcggttgcccagctcgcgctccaggggccgcttgctacggaagtgatgcagaaacttgcgccagaagcggatgttttctccattccaacgttttcatttattgaaaacgcaaaggttgccggttgtaaagtattgctttcaagaaccggttacacgggcgaagacggctttgaaatttactgccgcagtgaagatgcgctgaagctgtgggatgagatattggcgaaaggccgggaaaaaggcgttttgccgtgcgggctcggagcaagggatacgctccgctttgaagccgggctctgtctttacggccaggagctggcggaagacatttccccgcttgaagccggcatcggttttgctgtaaagcttaagaaggaagcggattttatcgggaagcaggcgctccttgcacagaaagcagaaggcctgaaacggcgccttgctgggattgaaatgatcggtcgcggcattccgcgccacggatacagcgtttatgcaggggatgagcggattggcacggtgacaaccgggacacagtcgccgactttaaagaaaaatatcggccttgcccttttgcgtgtaccgtgggacgcacccggcaccgaagtagaagtggacgtccgttccaaaaagattaaagccgtcgttgtccaaacaccgttctataaaaagccaaaaaacggaggaggggaaaagtgatgcatcgctacctgccaatgacggaagaagataaacgtgagatgctggatgcgatcggagtccgaagcgtcggggaactgttttccgacattcccgaaaaagtgcggtttaaaggggattaccggatcaaaaaagcaaaatcggaaacggcgctgttaaaagaactgtcagaacttgcggggaaaaatgccaatttaaaagaatatgcctcttttttgggggcgggggtttacgaccactatattccaacggtcgtggaccatgtgatctcaagatccgaattttatacggcctatacaccttaccagccggaaatctcgcaaggggaactgcaggctatctttgaattccagacgatgatatgcgagctgaccggcatggatgtggccaactcctcgatgtatgacggcggcacgtccatggctgaagcggccatgcttgcggccgggcagacgaagagaaagaaagtattggtttcaaaagctgtccatccggagtaccgggccgttttacatacttatgccaagggaaagggcatcaccgtggaagaaataccgctcgcagacggctgcaccgatctggaagcagctaaaaaacaaatagacggcgggacagctgctgtcatcgtccagtacccgaactttttcggttcgcttgaacggttaaaagaaatcggcgaactggcccatgccgaaaaagctttgtttgttgtatccgccaatctgcttgcccttggggtgcttgcgccgccgggggatttcggcgccgatattacaaccggcgattgccaggttttcggcattccaactgcattcggcggcccgcattgcggctactttgctacaacgtcaaaactaatgcggaaaatgccggggcggctcgtcggcgaaacggtcgacgagaacgggaaaagggggtatgtgcttacgctccaggcgcgcgaacagcatatccgccgcaataaagcgacgtccaatatttgctctaaccaggcgctcaatgcccttgccgcatcggtggcgatgagcgccctcggcaaaaaaggcgtaaaagaaatggcactggccaatatggcaaaagcacagtacgcaaaaaagaaattggcggaaaaagggtttgaaatcccgttttcgtctccttttttcaatgagtttcccgtgaaattgccaaaaagtgttcaagaagtaaatgaacatttattgcagaaaaaaatcatcggcggctatgatgtgggcaaggattacccggaatttgccggttgcatgctcattgccgtgacggaattgcggtcaaaagaagagattgaccaattggctgaagaaatgggggtcgtgtgtgatggcgaatgaaggaatgccgctcatttttgaacggtccaaacaggggcggattgcgtacagcttgccggaaatagatgtgccggaagtggacgcttttgacatttttccgcctgaatacgtccgcaaacaggatgcggaactgccggaagtgtcggaactggatttaatgcggcactacacgaagctgtcagaaaacaaccacggcgtcgattccggcttttacccgctcggatcctgcacgatgaagtacaatccgaaaatcaatgaaacggttgcgcgctttccgggatttgcccatatccacccgcttcaggatgaaagcaccgtccagggggcgctcgggctgatgtatgacttgcaggaacatttaaaagagattaccggtatggatgaagtgaccttgcagcctgctgccggcgcccacggggaatggaccgggctgatgctgatccgtgctttccacgaagcaaacggggatacaaagcggacaaaagtgatcattcccgattccgcccacggcaccaacccggcttccgcgtccgttgccggcttcgaaacggtcactgtgaagtcgaatgaagaagggcttgtcgatctcgacgacttaagaaaaattgccggggaagataccgcggcgctcatgcttaccaatccgaatacgctcgggctgtttgaagcgcatatccttgaaattgcggagatcatccatgacgcgggcggcaaactgtattatgacggtgccaacttgaatgccgtgcttgcgaaggcgcgcccgggcgatatgggattcgatgttgtccacctgaatcttcataaaacgttcacaggcccgcacggcggcggtggcccgggttcgggtccggtcggcgtcaaaaaagagctgatcccgtttttgccggtgccggttgttgtgaaaaaaggcgaccgttatgtgctggatgaagaccggccgaaatcgatcggcagggtgaagccgttttacggcaatttcggcatcaatgtccgagcctatacgtatatccgttcaatggggccggacggcttgcgggaagtgaccgagaatgcggtgatcaatgccaattatatgatgcggaaactggcgccgtattacgacctgccgtatgatcgccattgtaagcatgaatttgtgttaagcggcaggcgccagaaaaaactcggggtgcggacgtttgatattgccaagcggctgcttgatttcggcttccatccgccaactgtgtatttcccactcaatgtggaagagtgcatgatgattgagccgacggaaacagagtcgaaggaaacgctggatgcctttattgacgcgatgatccaaatcgcaaaagaagcggaggaaaatccggaaatcgtccaggaagccccgcatacaaccattgtcaaacgcctggatgaaacgcgggcggcacgaaaaccggttttgcgttatgtgaaaaagtaaaataaaaaatgccgcagcattgccgcggcattttttatttccctgatttgattttgcctgtccagtttttaaagccgcctttcaactggtaaaggtcgcggcagccgtttttataaagcatttcagcggcgcgcccggtgcgcgtcccgttctggcaatataaataaaccggtttatcggtccggatctcttttaatctcattttcagctgagacagcggaatattgcgtgcgcctaaaatatgtccgtttgcaaattcattcggttcgcgcacatcaatgagctgcgctttgcgataacccgccttgaattcttcttccgtcaagcttttcaggatttttttctgccggtagtatctggcgagagtatatgctactaccgcaacaataacaatgatgagtgtgtaccacgattgtgacatctttcgtgccccctttcttacctgatgcgctatctactattatattcgtgttgcgcttctgaatcaaaatctttttttaagaaacatgtcaccgctattttttcagctttttccgtttgaaaagcccgtaaccgttctgttttaagcaccagcggaaaaaccggcacaaacttgagcggggctttgccgttttgcgtcgttttttggtaaactggtaaagtgatattttaaagaagaggggtacatatgggaaaagaaacctggttgtttgtagattcaggccactgtccgccgttttttaacatggcgctggatgaggccctgcttgactggcacagcaaaggggagattccgccagccatccgcttttacggctgggatccggccaccctttcaatcgggtatttccagcgggcaaaacaggaaatcgatctcgaagcggtaaaacgatacgggctcggttttgtccggcgaccgacagggggaagggctgttttgcacgagcacgagctgacctacagcgtgatcgtgtcggaagcgcatccggatatgccgaaaacggtcacggaagcctaccgcgtcatttcagaggggcttgtcaggggatttcgtgcgctcggcctggaggcgtattttgcagtgccgcgaacggaagcagaacgggaggcactaaggtctccgcattcttcggtttgttttgatacgccgagctggtacgaactggtcgtggaagggcgaaaagtcgccggcagcgcacagacgcggcagaaaggcgtcattttgcagcacggctcgattttgctcgatatggatgaggacaagctgttcagcctgtttaaatatccgaatgacagagtgagagaaaggatgcagcggagttttaagaaaaaggcggttgcaatcaatgagctgcgcaacgttcccgtcacatacgaggaggcaaaagaggctttccataaggggtttgaagaagggctcggcatccggctggaaccgtacacgctgacgccggcgcaacaggcgtatgtcgaagaactggcagacagaaggtaccggtcggatgaatggaattttaagagataaatgaacatttgttttttttagcggccagaggtatgatttttcgctttttcctttagtgccgcgctttttatggctgcttttttgatgcaagcggcaaattttttcgttatgcccgggtttgcctgctttttcgagggatttctcagattttcggcatggtttattctttttttcatttgacaaaaagaaagaggtttgacctaaacacaatatatggtatataaaaacaaaatgtcaatacaatatctagtatttttgcttgcaatttttccctgcggtgtgctattttaaaggaggcagaaccaccagagaatttgcatggagaaatagagaaggagttgtcgttatgtctgttgcttcgacagaaaaattatggaatgtggagaagctgaacgaagatatccgcttatttccgcaggtccatccgattacaccggatatgaacattacgtacaaaggcgtttcaaggcttgtcatgattgacagatacgcgtttaaagacacggaaaaagtcacattgggcaagggcgattttgttgtcctcacgattaaagaagacccgaaatttccggccagggggctcggcgtcattaaagggatcgactgggaaaaaaatgaagcggaagtcttaattgaagaagattaccgccaggcgctggaacacccggatgaaagagaaacgggggtcatcaaaaggtcgcttgatatcattgaaaagcctcttgaagtctactacgaacaaatcgcaaaacggaatgcaaccggcttagcggcagtggaaaaaacagaagagaaacggaaagaatggtttgagaagttttacaatgaactggtaaacttaaactttatcccggcaggccgcgtcctctacggcgccggctcggaaacggaagtgacttattttaattgttatgtgatgccgtttgtaccggattcaagggaaggcatttccgaacaccgtaaacaggtgatggaaattatgagccgcggcggcggagttgggacaaacggttcgacgctgcgcccgcgcaatacgctggctagaggggtcaacggcaaatcaagcggctctgtctcatggctcgatgacatcgccaaacttacgcacctggtcgaacagggcggcagtcgcaggggagcgcaaatgatcatgctggctgtctggcacccggacattgtcgaatttatcatttcgaaaatgcagaatccgcggattttgcgtttcctgatcgaaaatacgaacgatgaatggatccgcaagcttgcccacgacaaattgaaattcacgccgctctctgaaatggaaaggcaaatgtaccatgggattgtgaactacaaacatattccgggccaaggcggctttacggaagaagtcatgaaagaggcggaagaaaaactggaaacaggcggccattacaccgttcataatccggaatttttaaccggcgccaatatttccgtctgcctcacaaaagaatttatggaagcagttgagcaagacgcagaattcgagctgaaatttccggatgtggaaaattacagcgaagaagaaatgcgcatatacaatgaagaatggcataagatcggcgatgtgcgcgaatgggaaaaacttggccgcaaagtgcgcgtctatcgcaaaatcaaagcaaaagaactttggaatttgattaacatctgcgcgacttactcggcggaaccaggcgtcttctttatcgacaacgccaacgacatgacaaacgcaaaagcatacggccagaaagtcgtcgcaacaaacccttgcggagagcaaccccttgcgccctattccgtctgcaacctggcagcggtcaatcttgcaaaaatggtcgacaaagaaacgaaagaagtgcgctgggaccaattgaaacaaactgtccataccggcgtccgcatgcaggacaatgtcattgacgcgaccccgtacttcctgaaagaaaacaaaaaacaggcgctcggggaacggcgtgtcggccttggcgttatgggcttagccgaccttctcatttatatggaaaaagaatacggatccgaagaaggcaataaacttgtcgacaaagtgtttgaaacgatcgcgaccgaagcataccgcgcatccattgagatcgcaaaagaaaaggggagtttcccgtttttaacgggtgaaagcgaagaagagacaaaccgcctgcgccatgcattcacggaaaccggctatatgaaaaacatgccggaagacatccgcaaggcgattttaaaacacggcatccggaactcccatttgctaaccgttgcaccaaccggatcgaccggcaccatggttggcgtttccactgggctggaaccgtatttttccttttcctatttccgcagcgggcgcctcggcaaatttatcgaggtcaatgcggatatcgtccaggagtatctggataagcacccggaaacggacaaagaccatctgccaaactggtttgtaaccgcgatggatcttgcaccggaagcccatgccgatgtccaatgcgttatccagcgctgggtggacagctcgatttcgaaaacggtcaacgccccgcgcggctacacggttgaacaggtggaaaaagtgtacgaacgcctgtataagggcggcgcgaaaggcggaaccgtttatgtggacgggagccgggattcgcaagtcctgacattgaaagcagaagaaccacaggaagaaaaacaggaaaaagcggaagtgaaacacgcgaaacagcatgtcgtcctggttgataccatcccggatatccggtcaacaaacgtcacatacggcaacgaaatcggcgatacctgcccgatctgtcggaaagggaaagttaaagagatcggcggctgcaatacatgcgataactgcggcgcacaattaaaatgcggcttgtaaacggaataatggagaaaaaaacggagcaaagtgatgctccgttttttttttcgcttataaaacaccggttaaaagaatcatcagaaaaatggttaaaaaattttaattcgaatattgacagcaaaaatgtccgatgctactatttatatatcaaaaacaatatataacgtgttaaaaacgttatataaattaaaatgataaaaaggagggcggttgatggacgaaaccgtttatgatgtgacgattatcggcggcgggcctgttggtttatttgcggctttttacggcggcttgcggcaaatgagagttaaaatcattgaaagcatgccgcaacttggcgggcagcttgccgcgctttaccccgaaaaatacatttatgatgtagccggcatgccaaaagtgaaagcgcaatcattggccgaccggttaatcgaacaagccatgcaatttcatccaacgattgtgctgaacgaaacggtgcaggatgtgaagaaaaccggccgcggcacctttcgcatcgaaacaggatcaggcctccatttttcaaaaacggtcttgatcacagccggtatcggggcatgccagccgcgccggattgaacacgaacaggcattgcaatacgaaaacaaaaacctccattattttgtgaatgatatgcgcaaatttaagggagaaaatcagtgcaccagaagcgatggcgtccgggctattaacgaaagtggttccagcctgccacttggaacaggaaacgcagcattttgctgaaaggcttgccgcgatgccgacaaaagcaatcggcctcgtgaagcggtatatgcaaaaaagctttgaaagcacattggatgaaatgctcgaaaatgaagcatacgcccagcagattgcagggcaaacagccgaccacaaggaaggggtccgggcattttttgaaaaaagaaaaccggaatacaaaggcaattaaacagaaaggatgaacatgcatgccgataacaaaagaagtagcagtatttcctgctgaaatgaaacggagcgcgtataaaatggtcatcaacggagaaccggtggatgctgccggcggcgaaacgtttcacgtctataatcctgcaaccggcgaagcaatcgccacggtgccgaaagcggattacgcggatgtcgaccgggccgttgaggcggcgcgccatgcttttgaacacggaaaatggaggcgctatccggttggaaaacgggcgcgcgtcctgaacaaaattgcctccattatgcgcagccgttttgatgcgcttgttgaaatggaaatattaaataccggaaagacgattgaaacggctaaggggcaagtgatgcaggccattgaagatttcgagtttttcgcgggggcaattgtcgggcatcgcggcgctgtgaaccatgttcccggccagttctttaactatacccaaaaagaaccggttggggtcgctgcccagatcattccatggaattacccgctcatgatggctgcatggaaaattgccccggcgatcgcagcaggatgttctgttgtggtaaagccggcaagccttacgccgattacagccattttactagctgaaatctgccatgaggccggtgttccggcaggcgttgtgaacgtgattaccgggccgggggcgaaaatcgggtcttatttggcgaagcatgaaggggtcgataaaatcgcctttaccggagaaacttccaccggaaaagagatcatggcaaacgcctcggaaacattgaaaagagtcacgctggaacttggcggaaaatctccgaatctcgtatttcaggatgcggatctcgatgccgccgtcaatggtgccctgtacggcatcttctataataccgggcaatcgtgcgaagcgagatcccgtattttcctgcaggaagacatttacgatgcgtttatggaaaaatttgtggccaaaacgaaaaaactggtgctcggtgatccgttttcacctgcctcgcatatcggggcgatcatcagcaaagagcagctggaaaccatccaccgctatgtcgaagaagcaaagcaggccggcgcaaccatcgtgacaggcggaaaaccggctaaagtggaagggtttgaaaatggttactggtatgaaccgaccattatcacaaacgtcaccaatgacagcaaaattgcccaggaagaaatttttgggccggtcgtggtggtgatgccttttaaagaggagaaggaagccgtaaaacttgcaaatgcgacgaagtacggcctggcttcaagcatttgggcaaaggaccagggcctaattaagcgggtcacagacggcatccaggcaggcattgtcatggtcaacagcccgttctccgcattcccggggacaccgttcggcggatataaacaatccggcttcgggcgcgaattaagcttcgaatgcctcgatttatacagtgaaaccaagagtgtactcacttatgcaggggcaaaacctttaaacccgtttcagttataagcttccggtcgaataaaggcactcattgctgcactggcagtgaaacgggtatccggcagggcaagatggacaaataagaagcgaacgcattctttcgggatgggttcgcttcttttaaaaatcgtctaaaaagatagaaaatgtaaagaggaagtggtatgatggcggaaacattggttgtcattggttcaggggtaatggggtgcggcattgcttatgcgggcgcactcggcggtttcaaagtcagactggtagatgtccggcctgacatcttgcatcaagcggaaaacaggattgaatccgtcatggaaaaagggctttcgagggggaaaatcaacggggcagatgctgaaaggataaaggcaaatatcgaatataccgttgatttgccggctgcagccggttgtgcagatgtgatcatcgaggcagtgccggaaaaaacggaaataaaaaaagaagtgtttgaaaaaatggacaggtttgcgcctgccggttgcatccttgcgaccaatacatcaacgatgagcccgactgaaatcggttcttttactacccgtcccgcatctgttattgccatgcattttttcaatccggtgcataaaatgccgcttgtcgagatcatcagggggcttgaaacaagcgatgaaacggttcaacgggctgaaaaaacagctgaaaaaatggggaaagaaacggtgatcgtgaatgaatttcccggctttgttacaagcagaatcagctgtttagttggaaatgaagcgttctacatgctgcaggaaggggtagggacagcggaagaaatcgataaagccgtcaagctcggcttgaattttccgatggggccgtttgaattggcggatttggtcggtttggatgcaaggctaaacaatttgcgctacttgcatgaaaagcttggcgaaaagtaccggccggcgcctttactggaaaagtatgtgaaagcgggcaggcttgggcggaaaacaggcaagggcgtatatgattacacaacggttgaaggagaatgaagatgagagacgtcgtcatcgttgatgcggtcagaacaccgattgggcgatataaaggagcgttaaaatcagtaaggccggacgatctggcggcaaccgccatcaaggcgttgctcggccgccatcccgaagttccctggaacgaaatcgaagaggtcattctcggaaatgcgaacggcgcgggcgaagaaaaccggaatgtcgcaagaatggctgcattgctcgccgggcttccggtcgaaaccgccggcacaaccgttaaccgcttatgcggatcgggcctcgatgctgtcaatatcgcagccaaagcgatcatggttggtgacggggatatttatattgccggcggaacggagagcatgacaagggcgccgtttgtcatggcaaagccggaaaacggctacccgaggggcaatttggaaatgtttgatacaacgatcggatggagatttgtcaatgaaaaattaaagaaaatgtacgggacagacagcatgccggaaacggcggaaaatgtcgcaaagcaatttcatatcagccggaaagcgcaggatgcctttgcttttacgagccaaatgagggcgaaagcggccatggaagcaaaccgctttcaagatgaaatcgtgcctgtcgtgtatacgaatcaaaagggggaatccgtgtctgtcacccaggatgaacatccccgccccgatactacgccggaaaaactagcaaggctgaaaccgctttttacaggaggcacggtgacggccggaaattcatcgggcatcaatgacggggcgtctgccgtgctattgatgagcgctgaaaaagctgtccaattgggggtcaaaccgatggcccggtttgtcgccagcgcaacggcaggattggaaccaaggatcatggggctcggcccggtgtacgcaacgagaaaagcattaaagcgcgccggatttactatttcggatattgatcttgtcgagttaaacgaagcctttgcttcccagtctattgcatgcatccggcagctggaactggacagtgagattgtcaatgtaaacggaggggcgattgctttcggacatccattgggagcaagcggcgcgagaattttaacaacgctcgtccacgagatgcaaaagcgaaaggcaaaacgggggctcgctacgatgtgcatcggggtgggccaggggattgcaaccgttatcgaaaaaatttaaaatgggggaaagagatctttggcagagacaaggagtttataaatggaaaaaacgttaaatacgcgttcgatgatttttacgctttatggcgattacatccgccattacggaagcgaaatttggattggcagtttaatcaaattgctggaagcgttcggccaccatgaacaatctgtccgtgctgccatttcccgcatgagcaaacaaggctgggtggaaagccgcaaagaaggaaacaacagttactattctttgactgaacgcggtgtaaaacggatgaatgaggctgccgggcggatttttaaactgaacccgggcaaatgggacggcaaatggcggttttttctgtatacgatacccgaaaaaaagcggaacatcagggatgaactgagaaaagaactgatgtggagcggcttcggcctcctgttaaacagtgtctggcttacgccgaatgatttgctggatgaaatgaaaggaatcatcgacaagtacgggatcaatgaatatgtcaaaatcttcactgccgaaaatgtatggggcaaatccgataaagaacttgtacaggaattatgggatattgattatatgaacgaccggtatgaagattttatggcccattaccgggaaaaatatgaaagcgtcaaagaaaagatgaaaagaggggaaatgacgaatcaggactgctttgtcgaacggacgatgcttgtccataattaccggaaactattgtttgtggatcccggtttgccggaagaactgctgccggaaaaatggaagggggaggaagcagccgcgcttttccgggactattaccgaatccttgccaaaccggcaaatgattttttcgaagacattttttctgaaggatacgacacttttcagaaaagcaaacattatgatgtgtttgaccatccgcttataactgaaaaagcatgatcattcgggcgcagaaaggagcgatcaagtggcaaatccggtaactgaaatgttgggcatcaaatttccggtttttcaaggcgggatgggaaatatcagtgatcctgcccttgctgcaagtgtttccaacgccggcgggctgggaacgattggcgccgggacgctgcccgtagcggaaatcgaaaaaagaatggataaaatgcgcagcctggccgcttccccctgctgcgtcaatattgccatttcggttcatccaaacgcggacgaagtcatccggttagccattgaaaaaaagattccggttgtttccctatctgccggcaacccttcgaaatatatcccggttctgcatcaaaacggcataaaagtgatttgtgtctcctccactgtccgccaggcgaaaaaagcggaagcagcgggggctgatatccttgtatgcgaaggatacgaagcagcaggaatcaatgctgccaatgaaagcacgacaatggtgctcgttccgcagattgtaaaagcggtcaacattccggttgtcgcagcgggagggattgcggacggcaaaggtttggcggcggcgctttcgctcggggcatacggcgtgcaaatggggacgagattcatcgcaacaaaagaagcgcagtttcaccctgtatataagaaggctgtaatggaagcaacagatgaagcgacgatgatcatcggcagacgataccaaatggtgcgcagagtgttcaaaaatgcgtacgcggtctatctccgcgaactggaagaaagcggcgcggatccgggccgctttaaagcgctgacaagcgaagtccatcatgaaaggggagcgcttcaaggcgatatggagcacggttttataaacgggggccaaattgccggccttattgaggactgcccgtctgttgcccaattattagaagaaatggtaaaggaagcgcaggctgtgctaaccaggagcatggcacggttatagtcccgtatgaacgctttgttctaattcctctccttgtgcgctaaaataataaaaaagcatttttcatctttcgcttaagcagggcatcctgccaacattccgtatcttttctgaccaacaaaccgaaacgcccgatgcgaatccaagggtgggtttccatggaaattgatgcggttttttccggtggaggcataaaaggccttgcgctcatcggggcattggaagtattggaaaaaaggggatttacgtttaaacggctggccggcacaagcgtcggttccgtttttgcagggctgttggctgcagggtatacaagcggcgaaatgaagcaaatgcttgcggaaacagacacggccgcgttccttgacgagcggaaaacgctgctgccggtgccgtttgcgaaatggctgctgctgtattggcggctcgggctgtacagaggcgccgcgtttgaggaatggatcggggaaaaactcgcatctaaaggcgtgtacacgttcaaagatgttccaaaaggctccctttatttcacggcatccgatcttacccataaccggcttgttgtattgccagatgacctagagcgttacggggtgccatggcaaacctttccggtggcaaaggccatccggatgagcgcgagcatcccgtattttttcgaaccggtacggctgcgctcgctggaaggcacgagccttattgcagacggtggcgttttaagcaattttccgatgtggctgtttgtcaaaccggaagaaaaaaaggcgcggccggtgctcggcatcacgcttagcccaaaacaatcagaagagccaaatgcggagataaaaaatgcgatccagctgttcgatgccttgttcaagacgatgaaagacgcccatgatgcccgctatatttcaagaaaactggaaaaggacattatttttatcgctgcagatggcgtacctgccacagattttcagctttccgccgaacaaaaagcagccttaatcgaggcgggccggaaaaaaacagaaacgtttctgaaaacgtggtcctattaattaaaaaagaatcgagcttagtagacagctcgatttttctttttgccctttttgccttcaatcacggttaactggacattggattttttgcgcagcggccgttttgaaaatttaaccgtgtggacagtatggaccttcatattccgttttttcattctttttctggatttgcgggcggcttttaaaaatgctttttgttcctggttggaaacatttgtgcttctcttgagtaagaaacgcatgccagccaaaagcactgccgcaaaaatgaaggctatcaaaaccctttttaagaatacaaccggctcatgaaacaaagaggaacccaggccaagcagggccaaaagaaaaatgccggcgatgatccattgacgcgtcttcaacaaaagccacctcctcatgttttcctaaccattttttccatcattctatcagtttatacggttccggccgtttttattttgaggttggtaccccgtcgcacaaacaagcttgtgatagtaaatgtattcccatgcactggaaacttcaaacgccgtttttaacgggcggcagaagccatatcacccgattccagttcaagcagcgcctgaaaggaggaaatcgcaacttcaatttgcttgtcatccggctcttttgtcgttaacagctgaagccacaggcccggatagccaagatatttcagaaccggaatatggcggactttattggtcagctgaagaacttcaaacgacgtgccgagcacgaccggaatcagcaaaatccggtcgatgatgcgaagccagagcggatctgtcgggacaagcgtataaatcaggacgctcacaatcacggtaaacagaataaaactgctgccgcaccggtaatgcagcctcgattgcgagcggacgttttcaacggtcagggcaagcccgttttcaaatgtattgatgactttatgttcagccccgtggtattggaatacccgcttgataaacggcgttaaagaaatcaaataaatatacgaaagcacgagcagcagcttaaacgcgccttcaatgagaatttgcgcggtatctccggaaaaaaacggccttgtcagttctgccagaaaaacgggaatcagcgtcatgaaaaatttggcaaacaaaaaggacaagacgccggcagcagccacgccgagcaccaccgttgtttttgccggggctgcttccttccttttttcgtcttcttccgggtcaacatcataccgctcgcttgcaaaattcaaatgctttgccccgtttgcggatgattcaatgatggcaatgatcccgcgcaaaaacgggattttttttaatttttgaatgaacgggcgcgtctctttcggcagataaaagaagtcgatccggttgtttttgcggcggatggcagtgaccgaatgccgctttccgccgaacatgaccccttccacgactgcctggccgccataagctggttttgtcaatttcttctcccccaaacctaaacttcgaatgtttctttcccgtttaagacggaatggatttccgaaacgttacttacgcttattttactaaatcattttaaatacgactaggggaaagacttatgggaaagataagaaagaaaagatgcgcgccgtccatgtgaaggggtggaaaatatggaaaataacagcaaagcaatgaaaaaccaggagcattccatgaccttttttcaaatggtgcttgtgaccggatttgcgggcgggatcatttggagcctggttgcctatttatgcttttcttttcattttacggcgattgaaccgaatgtcctgcttgaaccatttacggtaggatcctggcgcaaaatgtggatcggaaaaaccatttccatactggtatacggattgttctctaccggctgtgcccttgtctattatcttttctttaaaaaattgaaatcgatgtgggtgggcgcgatctacgggctttgcctgtgcgcggtcgtcctgattgtgctgaatccgatttttcccggcatgaagccttttttaaaactcgatgccaatacgattatcacttgctgttgcatttacattctctatggggtgtttatcggttattcgatttcgtttgagtatgaaagaagccgggtttttaagagaaaactggagagacagtcgaacccgctcccgtaaatcgatccgggcgggaggaacgcccaggattcaggcagatacatgcaggcggaaagtaaaaaatagaaattttcttcaatttatggtaaaatgggcacgttaaatatgggaaaaaggtgcttgaaatgaaaaaatacctcgtattaaacggcccgaatctgaatttgcttgggcaaagggaacccggcatttacgggaaagattcgataaaaaccctgatggcacgcatggaagcggcggcccgagagcacggcgttgccatcggttttttccaatccaaccatgaaggcgccctgattgacaagctccatgctgccggggatgaaggctttgccgggattattttcaatccaggcgcgttcacgcattacagctatgctttgcgggacgcgatcagtgccatccgcctaccggtgattgaagtacatatttcgaacatccatgcccgcgaggaattccgccaccattctgtaacggcggctgttgcgcgcgggcaaattgcaggccttgggctgtacggctatgagcttgccctcatggccttgcttgaggcagaaaagggagaggaagaaagatgttaaaattggagaaactgagagaagcatttccgcaggccgctattgacggcttgctcatcacaagcccgtataaccgccgctatatgtccaattttacgggaacgaccgggattgtccttatatccggggaagcggcaaaatttattacggatttccgttatgtcgagcaggcatcaaaagagtgtgaaggctacgaaatcgtccagcatcagggaccggtggaacaggaagtggccaaacaggtagaagcaatggggatcaaacggctcgggtttgagcaggaccatatgagctatgcgctttttaaaacgtatgaagggctgctcgatgcagaactggttccggtttccgggcttgttgaaaatttgcgcttgatcaaaacagatgcggaaattaagatattaaaagaagctgcggatattgcagatgctgcttttaaacatatccttgacttcttaaaaccgggcgtcacggaattggaagtttccaatgaactcgaatttttcatgaggaaatgcggcgcgaccgcttcttcatttgataccatcgtcgcatccggcctccgctctgccatgccgcacggggtggcgacggacaaagtgatcgaaaaaggcgatttggtcacgatggattacggtgcgctctataaaggctattgttcggatataacaaggacggttgccgtcggggagccttccgagcaattgaaggaaatttacaatattgtgctggaatcgcagctgcttgccgtcgaaaacattaaaccgggcatgtccggtgttgaagcagacgccatttcccgcgattatattgcccagaaaggttatggtgaagcgttcggccactccctcgggcacgggatcggccttgaaatccacgaaggcccgaatctttccatgcgctcggcttatactttggaaccgggcatggttgtcaccatcgaaccgggtatttatgtgccgggtgtcggcggcgtccggattgaagacgatacggtgatgaccgaaaattcgaatgaattgctgacgcattccgcaaaagaactgattatattataatagttacagcccttaacaggggatcgaatgaacatgtaggaggaaaaatatgatttcagtaaacgattttcgcaccggcttaacgattgaagtggatggcggcatctggcgcgtcctcgatttccagcatgttaaaccgggaaagggcgccgcttttgtgcgctcgaagcttcgcaatttgcgtaccggcgccatccaggaaaaaacgttccgtgccggcgaaaaagtcgaaagggcacagatcgacaaccggagaatgcagtatttatatgcaaacggcgaccagcacgtatttatggatacggaaacgtatgaacaaatcgagctgagcagcgcccaaattaaagacgagctgcaatacttgctggaaaacatggaagtgcaaatgatcatgtaccaaggagaaacgctcggcattgaactcccgaatacggtcacgctgacagttacccatacggaaccgggggtaaagggcgatacggcaacaggcgggtccaaaccggccacgcttgaaaccggcctgacggtacaagtgcctttctttgtaaatgaaggcgataaattgatcatcaatacaacggacggttcatacgtgtcccgtgcctgattgctttgaaaaaagcttggcgtcccaaacggcgtcaagcttttttgcttttccggcaagataggaaaaaaataagtttacataatcatattataaacaacttaaactttcagagcctgccactgcttccttgtcatagttttcaaacccggcgaatagattgtactatccatgaaccaaactgtatgttttgaaagcagggatgaagaatggaagatttgctgggcattttgccgaaatccttatccaaccagctggaaaagttgggggatatactcgaagatgtggaagaaatccgcatccgcgtaaaccgcccgcttgaaattacttcaaaaggaatcccgcattttttgcgctacatgccaacggagagcgatgccgagcagctgatcagccggcttgcgaatttctccttttacgcccttgaagaagagctgaaaaagggatatgtcacgatcagcggcgggcaccgtgtcggattcgcggggaaagtcattcttgaaaatggacaagtaaaggcgatccgctatttttcatcttttaatatccggattgcccgggaaaaaatcgggactgcagatccttatctttctgcccttcacaacgggcactggttgtccgcgatgatcatcggggcgccccagaccgggaaaacgacatttttaagggatatcgcacggctgatttcaaccggcatcccggaacgcggcatttcgcccgccaaagtgggaattgtcgacgaacggtctgaaattgccggctgcgtccacggcatcccgcaactccatttcgggccaagggtcgatgtgctggatgcctgcccgaaagcggaagggatgatgatgctgatccggtcgatgagcccggatgtcatcatcgtggatgagatcggccgcgaagaagatgcggcggcaattatggaggcggtaaatgcgggcatttcgctcgtcatgacaacgcacggggaaaacttccgggatataaataagcgcccgattttaaagaaaatcctcgaatcgtatgcgtttgaccgttttctcgaactgtcgcgggggagccggccgggaagggtaacagcagtccgggatgcggaagggaacatcattcgtaccggtgaaggtgtttcccgtgcttaaactttttggagcagcactgattgtgttcgccaccagtttcatcggctttgaggcagcgaaacggttaagcgaacgcccccgccagctaagaatttttcaaagcgcgcttcaagcactggaggtggaaatcatgtacgggcataccccgctgcatgaagcggcaagaaaactgtcagaccagcttccggatccggctgccgccttcttccgttcctttgccggccagttgacaacattggaaacaacggtaaaagaagcatgggaaaaaagccttgacgggatttgggaactgacggccctgaaagaaaatgagtatgaagtattgcggcaactcggggaaaacctgggcaaacatgaccgctataccgagcaaaagcagctgctcctggccctttcgcatttggaacgggaagaaaaagaagcgcacgaaaggcagctccgctatgaaaaaatggcaaaaagccttggcgtcctcacgggtttactgatcgctattttactgatctgagagatgcacggatcatattgggggaaaagcaatgggcattgatgtggatatcatttttaaaattgccggggtcgggattgtcgtcgcatttctccacacgattcttgaccaggttggcaaaaaagaatatgcgcaatgggttacgcttctcggttttctttacattttgtttttagtggcatccatcgtaggggatttgttttccaaaatcaaaacggtctttctttttcagtaagccgggaaaaaaggggggatttcccattgaaattttgcaaattgcgggtgtggcgctcatcacgactttccttgcgctcatattaaaagagcagaaaccgaattttgcctttttgctgacgctttttgccggctgttttatctttctatttctggtggacaagatatatgagatcatccgcctgctgcaaaaaattgcccaaaaagggaatgtcgacacgatgtatatcgaaacgatcctgaaaattatcggcgtcgcttatatcgccgattttgcatccaatattacaaaagatgccgggcagggggcacttgcggcaaaggtggagctggccggcaaaatcataattttaacaatggccatccccattcttaccgtgctgattgaaacgattgtcaatctcgttccgcgtgcagggagttgagaatatggggcgcaaaaaaatgtgcatcgcgcttttcattctgtttgccttctgtttcttcgcacagccggcatccgccgcttcggaaaatacggacaaacaggagaacattccggaaaaaatggtcgatgaacaactgaatcaattggacttatcagaactgaaaaactactgggatgaaattgtcagcaaatacggcggatacttgccggaaagccagaaagggagccttatggattttatgaaaggcgaaaagcatttttctttgcaagcctggctgaaagggctgctttcgtatatttttcaggagctgctgatcaatgcaaaactattaggctccctcatcattcttacgattctgagcatcctgctggaaaacctgcatcattcgttccagcaagggacgatcagcaaaattgcgtatgcggttgttttcatggtgctcgtcattattgccctgaacagttttcatgtcgcccttcaatatgcgcttgaggcgatccggacaatgaaaggttttatcctggcgctgatgccgctcttgctggcgctgctttccacatcgggcggcgccggatcggcagccttttttcacccggtcattatttttctctccggcacaagcggcatgctggtcgagatcatcgtgctgccgcttctgctgctttcaacgctcttaggcgtcgtcagcaccctctcggaacagcacaaagcaacacagctggccggtctgttgcgcaatctcgggatcggcatactcggcgcttttatggctgtgtttttaggcgtcttgtccgttcaggggacggcaacggcggtgatggatgggcttgcggtcaggaccgcaaaatttgtgaccggcaattttgtcccggttgtcgggcggatgctgacggatgccgccgatacggtgatcagcgcttccgtccttttgaaaaatacgctcggcattgcaggtgtcgccattgtgctgctcattgcggcgtttccggctatcaaaattttcgccatgtcgttcatgttcaagctcgcttccgcccttttgcagccgctcggcggggggccggtcatcagctgtcttgatatcatcagcaaaaacatgctgtacgtatttgccgccctcgcgattgtgaccatcatgttttttctcagcattacgatcatcgttacggcgggcaatcttacgatgatgatgcgttaaggggggagacctgtggacgttttgacaaaatgggtgctgaatatcatcatttttatccttttggcgaccataacggacatgcttctgcctgactccgggatgcggaaatatacaaagcttgtgaccgggcttttgctcattgccatcatcgtcacacccgtattccggctcttttccacagatcctgccatatggatagaaaaattcggggattccagtacttcaagcccgtctgcggaagaaaatgcgcttgaaacgaagaaaaaagaaataaatgacatgcagcaggaatatacattacaacaaatggctgtccaactgaagcaggatgtggaaggggaggtagaggaagcgtttggaaaatcgatttcaaaaatcacggtcgagtggaaagacggggccaaaagcggggatcttaccgctttaaaagcgtcaaacgtaaaaaaaatccacgtctatctggaagcgcaaaacgaaaaagagactgttgctgccattaaaccggttgaaatcgggacggataaacaaacagaaaaacaaagcacacgggagcagcaatcgatcattgccatgttgtcaaatcgctggaaaatcaataaagaaaaaattgatctccgtttcgaaggggggcttgaaaacgaaaatggatcgtaaccagggaccgttcaaaaaactgaaagaaaaatggctgccatccggcccgccggataaaaagaaaaagcttgtgttgttaaccgtactattgatctccggtctcgggatgatgtttatcaacgaccttttcgggacttcaagcgaaaaaaacgaagcgctgactgcatcttcacccgtaaaaacggcaggcggaaaagggacagccgcattcggtgcaggcacttccaaaaaatcaaaatcgatctccacgtacgaaaaccaatatgagaaagaactgaaaagcattctggaacaaatcaagggcgtcggttccgtaaacgtccaagtgaatgtggccacatcagaaagcaaagtgtacgaaaaaaacgccaccatccggaatgaaacgacaaccgaaacagataaaaacggcggggaacggaaaattgacagcatttcaaaagatgataaagtcgtcatcgtccaaaacggggacaaggaagtgccgcttgtaacggaaaccaggaagccggagatcacaggggtgttagtcgtttgcgagggtggcggcgacgtctccatccaaaaatcggtaaaagaagctgttgcaagcgcccttgatatcgcaagttaccgtgtttccgtcatgccaaaaaaagaatgaggaggaatgggtatgcttttgaaaaaacaaacggtctggctgttgaccatgttaagccttgttgtggttttgtccgtgtactatgtgacggcggaaccaaaaacgacgaatcaggttacccggcaagaaaaagaaaaggaatctgcggcaacgaaggaaaaggcttccggttcgcaaaaaatcaaattgacaacaaagtctgccagtgatgaagtgtttgagacgctccgccttgagcggcaggatgaaatgagcaaaaagcaggaagaactgaccaataaactcgcatcgaccgacctgacgccggatgaaaaaagcaaggcaatggatgaaatgaaaaaattaacggagacggcgaataaagaacaggttttagaaagcctgatcaaagcaaaaggatatgaggatgcgctcgttcaggcagacggcgatgaagtggtcgtgaccgtcaaatcgaaaaagcacgataaagcggctgcaaatgaaatcgtcaagcttgtgaaccaggaattgggcaatacgccaaaactggccgtggaattccagacaaattaaggaaagccagaatagggggcggttacagcccttttttctgtgcggaaaacaagggagattgcttttttgccgggctttttttctatatttaaaaaatgattgaaaaatgattgaaaaatagatttgcgcgtgattttaaatttccgtaaaacgcttcctcctttttgcgccaagcggggaagggcatttttgcaatgtgccgggaatccgttttttatacaaatgattgaattttcgcctccggttatcgtatgatatggatagttatttattcataaattgttaacaattttagaagctgaaaaaacgaaggagtgtcatatatgctgaaagtagaggaaatccaggctttgatcgagcttgtggaccgttcaaacctcgatgaatttgaatttgaaaacgacgggaccgtcatcaaaatgaagaaaaacaccggcgtccaagtcattgaacgcccggtgcgtgaagtggctcaggtttccgcacccccgcaaatgcctgcgcagccccgccagcttgcagaaaacccgcagcctgaagctccggcgcaagcagccgacgaaaatctgcataaaatcgtgtcgccgatggttggcaccttttaccaggcgggttccccggaagaagaaccgtatgtgcaaatcggctccaaagtcagcccgaatacggttgtatgcatgattgaagcgatgaagctgtttaacgaaatcgaagcggaagtggaaggggaaattgtagatatcctcgtcaaagacggccagcttgttgaattcggccagccattatttttggtaaagacaaagtaaggagcggactttcatgattaaaaaagttttgattgcaaaccgcggcgaaattgcggttcggattatccgtgcctgccgcgacctcgggattgaagccgtggccgtttattcggaagcggacaaagatgcactgcatgtccagcttgcggatgaagcgtactgcatcggcccgaaagcatcgaaagacagttatttaaattttgccaacatcatcagcgcagcaactttaacaggctgtgacgcgatccatcccggttacggatttcttgctgaaaatgccgattttgccgagctttgccgagaatgcaatattgagtttatcgggccaagcccggaagccattgcgaaaatgggcgcaaaagatgtggcgcgcgaaacgatgaaaaaagcgggcgtgccgattgtcccgggttcggacgggcttgtaaaagacgcagaagaagcaaaagtcgtcgcaaaaaaaatcggctatccggtgattattaaggcaacggccggcggcggtggcaaagggatccgcgtagctttgaatgaagaagagcttgtaaaaggcatccacatcacccagcaggaagccgcgactgctttcggcaacccgggtgtttatcttgaaaaatacattgaagacttccgccatgttgaaatccaggtcatggctgataaattcggcaatgtgatccacctgggcgaacgggattgcaccatccagcggcggctgcaaaaactgcttgaagaatccccgtccccggcactatcgagcgaaatgcgcgaagaaatggggcaggctgccgtgaaagcggcaaaagcggttgactatacgggggccggcaccatcgagtttatttttgaccaccgcaaccagaagttttactttatggaaatgaatacccgcatccaggtggaacacccggttacagaaatggtcactggcgtggatcttgtcaaagaacagatccttgtggcatccggggaaccgttatccttaaagcaggatgaagtcacatggaacggctgggcaattgaatgccggatcaatgccgaaaatccggaaaagaattttatgccgtctgcgggcaaaattaacttttacctgccgccgggcgggatcggcatccgcgtggaatcggccgtatatccgggttacagcattccgccgtattatgattccatgattgccaagctcattgcctacggagcgacgcgcgatgaggcgattgctcgcatgagacgcgcgctcagcgaatatgccgtggaaggcgtccacacgacgattccgttccatcagcgcctcctcgaacatgaagtttttgtcgaaggggatttcaacacgaaattccttgaaaaatatgatgtaatgaaataacgtgtaattataggaggtgttgaagatggcagaagacaaccaaatgttggaaatgcatcatgatgaagacggcttgggaaaagtggaaattgctcctgaagtgattgaagtgattgcgggcattgccgcttccgaagtcgaaggggttgcccaaatgcgtggcaatttcgcaagcggcgtcgtggagcgccttggcaggaaaaaccacgggaaaggcgtaaaagtggaactgagtgatgatggcattaaagtcgatgtctattgcaccatgaattttggcgtttccattccggcagttgcccaggaagtccaggataatatccgccaggctttgctcaatatgactgccctggaagcgtcggaagtgaatattcatattgtcggcattcaatttgatacgcagaaagcggagcctgaatttcaggcggaagagtaagagaaaaagggtccgggcaaagcgtcctggcctttttttggtcccacctttctgttacaataaaagcatgcgaatttgagctttttaaaggagttactgccgaatgatgaaaagaagaaccgcccgcgaaaaagcgcttcaggctttattccagatggatatgaatgaagcgagcccggaagatgcgatccggaatgcgctggacgggcaggaaagtgatgattatcttgagaaattggtaaacggaacggcaacacatctcgcggaaatcgacgccatgatcagccagcatcttgaaaattggacgcttgacaggcttgcaaaagtggaactcaatattttgcgccttgccgcttacgaactgatgtacgcagaggatgtgcccgccaatgtggcgatcaacgaagcactcgagattgccaaacggtttgcagatgaaaaatctgccaaatttattaatggcgttttgaatcaaatgaaagactcgattgaatctaaataacgggggatggataatgggagcggaaatcattgacggaaaacaactggccgaagcactcagaaaagagataaaggcggaagcggagcagttaacgcaacaggggattatcccggggcttgctgtcatattagtcggaaacgatccggcttcacgtacatacgtcaaaaacaaagaaaaagcgtgccgcgcgctcggaatgaaatccgttttaatcgagcttcccgaagacgtgtcggaacaggcactgctcggacatatcgcaaccttaaatgaagatcctgacattcacgggattctcgtccagcttcctttgccgccgcatatcaatgcgcaaaaaatcgtggaagcgatcagcccggagaaagatgtggacggtttccatccgataaatatcgggaggatgatgacgggccaggatacctttttaccctgcaccccccacggaattttaaaaatggtgaagtcaaagggcatccggatcgaagggaagcatgttgtcgtaatcggccgcagcaatattgtcggcaaaccatgcggccagctgttcctcaatgaaaatgcgaccgtcacatactgccattcgaaaacggccgatttaaaatctttcacccgccaggcggatattttggtcagtgctgtcggcaaagcaaaattcatcaaagcggattttgtcaaagcgggtgctgccgtcattgatgtcgggatgaaccgtgacgcgtccgggaagctgtgcggggatgttgactttgatgaagtaaaggagaaagcttcctatattacccctgtcccgggcggcgtagggccaatgacgattaccatgctgctttccaatacagtaaaagccgcaaaacgcttgtaccgttaaacaggctgccctgccgtcacggcatttttccggaaaaccgcttatcgtccggaagtgtgccgggagacatttgtgctgggagcgggcggcattaaaagaaagctgacttccggcgggaaggcagctttcttcatgcatgagaaaggtggtggaaagcgatgcaatatttatccgtacacacgctgacaaaatatatcaaacggaaatttgacgcggacccttatttaaacgatatccatgtaaaaggggaaatttccaatttcaaacggcattcaagcggccatatgtactttacattaaaagatgaaaaagcgagactgctttcggtcatgtttgcttctgcaaaccggacgttgaagtttatgccggaaaacggtatgaaagtgctcgttacgggttccgtatctgtttatgaagcaggcggcagttaccagctgtatgtgaaaagcatgcagcctgacggaatcggcgcactttatcttgcttttgaacagctaaaagaaaaactggagaaagagggcctgtttcaaaaccgccggcccatcccggcttatccgaaagtgatcggggtgatcacatcgccgacaggggctgctgtccgcgatatcatcaccaccatcaggagaagatatccggttgctgaaatcattttacatccggcccttgtccaaggggaaaatgcagccccttcgattgtaaaggcaattgaacaggcaaaccggatcggcaaagcggatgtgctgatcgtcggaaggggcggcggttccatcgaagagctgtgggcttttaatgaagaaataacggcccgggcgatctttgcgtcaaatattccggtgatttctgctgtcggccatgagacggattttacgatcgccgattttgcggcagacttacgggcaccgacgccgactgctgcagctgaacttgctgttccccatattgatgacgtacgggaaaaaatcttgcatttaaagacgcggcttatacgaaacatgcgggagaaagtacgctatgaaaaaagccggcttgcttaccttgaacggtcgcccgttttgacaaatccttaccggctcatccgccagcaaatcgagcaggctgatcgccttacagatcgcctgcacagggaagcggggcgcttaatcggtacagcggaggaacaaacccgcaatctgcacggccggcttttgcgcaaccgtcctgaacagaaactgctgcaggcgcggcggaatttcacgagccttgaagcaaacctcgtgaagcaaatgcaagcggtcttgcgggagaagcagcatcgttttgccaaaaatatttccgcccttgaagcgctgagcccgttgaaagtaatggaaaggggctacagtctggctatggcggaagacggaacgatcctgaaaaaaacaagccaggccaaaacgggtgaaacgatccgggtccggttgacggacggcggccttttgtgcacggtagataaaattgaaagggggaaaaaagatggccgattcattaacttttgaagaagcgatggtgcaactggaagacattgtgcggaaactggaagaaggggatgtgcccctcgaagaagccatttccatttacaaacagggaatggagctgtccaaattactccacggaaaactgaaaaatgtagaggaacagctggcaaaaatcatgtcggaggatggcgaagagcaggattttgagatccgggaggaggaataaccgtgcagaagcctgcgtatgatgtgaaagaaattgaaaaacacctggcacaatatatcgcggatcttcgtgcgcctgctgtattaaaagacgcgatgcattattccctccaggccggggggaaaaggatccgcccccttcttttgttgtcaaccgtatccgcgctcggtaaaccggctggtcggggcatgcagaccgcgtgtgcagtcgagatgctccacacttattctctgatccatgatgacctcccggcaatggacgatgatgatttgcggagaggaaagccgaccaaccataaagtatttggcgaagcggtggcgattcttgccggcgacggccttttgacgcacagtttcggactgattgccgaagatccggggttggatgacgctttgaaggtaaaactgattgcgctccttgcaaaatctgcgggtccggaaggcatggtcgccgggcaggtggcggatatggaaggcgaaaataaaacactgaccctcgaggaactacaatatatccatgcccacaaaaccggcaaactgcttcgtttcagcgtgcttgccggcgcgatgattggcggcgcgtcaacagagcagctggaaaaattcgggcaatttgccgatcatctcggcctcgcttttcaaatccgggatgacatattggatatcgagggggaacaggaaaaaatcggcaagcgggtcggcagcgatgaatcccgccataaaagtacatatccggctcttttaacgcttgagggtgccaaacaagaactcaggcgccatactcgccttgcaaagcagtgcctcgctgaaaccggcgctgaaaccggcgccttaatggaactgacggggatgatcgaaacgcgggaccattaacggccgttcatttggcgcaaaccgaacggccggaacagcaaaaccggcggcgtttgtttaaatgaggtatttcttgtctaaacgcgttgattgtttataatagatgtaagtgatgccgtatattgatgaggaaagcgagtgatccgcattggatcttgaatcgatcaaggacccgtcctttttgaaacaaatggacatccccgctttgaaacaactgagcgcggaaatccgccgctttttgattgaaacattgtcgaagaccggcgggcatatcgggccgaatcttggtgtcgtggaattgacgcttgccctgcataaatgctttgacagcccgaatgataaaattctttgggacgtgggacaccagtcatatgtgcataaaattttaaccggccgggctggagagttcggctcactgcgccaataccacgggctttcagggtttccgaaacggaatgaaagcattcatgatgtctgggaaaccgggcacagttccacttccttgtccgccgcgatgggcatggcggtcgcccgcgatttaaaaggagaaaaatcgtatattgtcccggtgatcggagacggcgcgctgaccggcggcatggcatttgaagcgctcaaccatatcggccatgaaaaacgggatatcatcgttgtgctgaatgacaatgagatgtcgattgccccgaacgtcggcgcgcttcaccaggtgctcggcaaactgcgaacggcgaataaataccggcgcgcaaaagatgaactggaattcctgctgaaaaaaattccggctgtcggcggaaagcttgcggccactgcagaacggctgaaagactcattgaaatatttgcttgtctccgggattttttttgaagaactcggtttcacttatttaggccctgttgacggccatcattttgatgcattgctcgaaaatattcagtatgccaaaaagacgaaaggcccggttcttttgcatgtcgttaccaaaaaaggaaaaggatatgaaccggccgaaaacgatacgaaaggcgcctggcacggcaccgggcagtataaaattgaaaccggcgattttatcaaaccggcggatgcccctcctgcctggagcaaacttgttagcgataccgtcctcagccttgcaaaggaagatgcgcgcattgtcgcgattacgccggcaatgacagttggttcgaagctggaacggttccagcaggagcttccggaaagggtatatgatgtcgggattgccgagcagcatgccgccacttttgctgcagggcttgccacccagggcatgaaaccgtttttggccatttattcgacattcctgcagcgggcgtatgaccaggttgtccacgacatttgccggcaaaacttaaatgttttcatcgggatcgacagggcgggccttgtcggcgcggacggcgaaacccatcagggcgtatttgatattgcttttttacgcagcctgcccaatatggtgttaatgatgccaaaagacgaaaatgaaggccagcatatggtatacacggctttaaaatatgacggcgggccgatcgcgatgcggtttccgcgcggcaatggcctcggcgtagcgcttgatgaagaattaaaagaaatcccgcttggcacctgggaagtcttgaaagaaggaaatgacgtgtgcatccttacctttgggacgacgattccgatggccatggaagcagcgaaatttttgcaaaagcaagggatatcggttaaagtggtcaatgcgcgctttatcaaaccgcttgatgaagcaatgctcgaagccgttttccgcaccggaatgccggtattaaccgtggaagaggccgtgcttgcaggcgggtttggcagcgcagtgttggaatttgcgggtgatcgtggcttctctgatcggatcattcgccgtattggcattcccgaccgctttgtcgagcacggcagcgtaaaagaattatggcaggaaatcgggctgacaaaggaccggctgatccgggaagtccggcagatattgcctcaaaaacagcaaagaaaggcttcattttaaatgaaaaaagaacgggtggacgttctcctcgtagaacgcggattaatcgaaacaagagaaaaagcaaaaagggcggtcatggcggggcttgtcttttcaaatgagacccgccttgataaaccgggtgaaaaaattgctgctgatgccccgctcatcgtaaaaggggatccccttccgtacgtttcccggggcggactgaaactggaaaaagcgttgaaagtatttggacttaatgtaaaagacaaaattgttctcgatattggcgcttcgaccggtggatttaccgactgtgccctccagcacggtgccaaaatgtcttatgccctcgatgtcggttataaccagcttgcatggaagctgcgccaggacgagcgggttgttgttatggaaaggacaaatttccgctatgttaccccgcaggatttcacaaagggcattccggaatttgcctcgattgacgtgtcctttatttccctgtccttgatcctcccggtattaaaaacgctccttgcacctttaagcgatgtggtcgccctgattaagccgcagtttgaagcggggcgcgagcaggtgggcaaaaaggggattgtaaaagataaaaatgtccatcgcgaagtgatcgaaaaaatcatccagcttgccttgcgtgaaaacttttcggtggaaaacctctccttctcgccgattacaggcggggaaggaaatattgaatttttaatccacctcgtaaagcccgccagcgaaacagaaggcggcgccaaccggttgcgcgtaaccgtaaatgacgtggtggaagaagcccatgccacgctcaggaagggatagacaaagatttggcagcctattggataaccggtaggctgctttgtataagggcgtttcgcacccgaaaaaaagcccgtttacggaaaaaagctgcttgtacatttgcccgtaaatgcgctaacatacaagtagatgcatatttacaaaagagcatccttgaggtgaggatatgaataaaggacagcgcttgatcaaaatcagggaaatgattaccaattatgatatcgaaacacaggacgagcttgtcgagcatttgcgcaatgccggctttaatgtgacgcaggccaccatttcaagggatataaaagaacttcatcttgtcaaagtgccgctcaataacggcaggtacaaatacagcttgcctgccgaccagcgcttcaacccgatgcagaaactgaaacgggcgctgacagatgcatttgtcagcattgatacagccgggcacctgatcgtattgaaaacattgcccggtaacgcgcatgcaatcggcgctttgattgatattttggattgggaagaaattatcggctccttgtgcggagatgatacatgcctgatcatttgcaaaaaccaggatgagaccgaaacggtttcgcaacggtttttggacttgctgtagaaagtggtgatgtttgattgctgcaggaattatcgattaaaaattttgccattattgatgcattaacgctttcatttgaagccgggctgaccgtcctgacaggggagaccggtgccggcaaatcgattattatcgatgccatccagcttctaacaggcgggagagggtcatcggagttcgtccggcacggggaaaaccgtgctgagattgagggcttatttctggtcgaggacggtcatccgtgcatggatcgcgcccgcgaattcggcattgagattgaggaaggcatggtcattttgcggcgcgatatatcgaaaacagggaaaagcgtttgccgcatcaacggaaaacttgtgacgatttcggtgctgcgcgaaatcgggtcgactttaattgatatccacagccagcacgaaacgcaggaactgctgaacgaaacgtaccatctgccactgcttgaccagtacgggcaaagtgagattgaaacggctctccttgattacgaaaaattgtataaaaaatacgaagccgtttacgggcggttaaaaagaatgaatgaaaacgaccagcagctcgcccagcgccttgacctcatccaattccagcatgaggaaatccaaaacgccggactgaggctgcatgaagacgaggaattagcggaagaaaaacgaaaactcgtcaattttgaacggctgtttgaatcattgaatacggggtatgaagcgcttgccggggaacagcatggcctcgactggctcagccttgccatgagccatcttgaaaccgcggctgaagtggatggcgagctctctgacattttggaatccgtccaaagttgtttttatacgctcgaagacatgtcccgctcaatccgttcccggcttgacggacttgaatttgacccggaacggcttaacgtaattgaagcgcggctgaatgagatcaaccagttaaaacgaaaatatggtagctcgatcgaagaaattctggaatacgggtccaaaattgaagaagaaatcgaatcgatcgtaaaccgtgaccatcatgtggagcttctagaaaaagaactgcaaacggtaaaacgcgatctgtatttggaagccaagcagctcagcgatttacgcaaaaaatgggcggaaaagctgactaaaaatatccattccgaattaaagcagctgtatatggataaaacaaagtttgaagtccgttttcttgccgctgctgatgattattatgaggcggatgacattccgttccggcgcgacgggctcgaccaggttgaattttacatttccaccaatccgggcgaaccgctaaaaccgctcgcaaaaaccgcttcgggcggagaattgtcgcggattatgctggcattaaaaacgatattttcccggcaccaggggatcacttccgtcattttcgacgaagtggataccggcgtaagcggccgcgttgcgcaggcgattgcggagaaaatttaccgcatttcggtccattcgcaagtcctctgcattacccatctgccgcaggttgccgccatggcggatacacatctgttgatcatgaaagagactgaaaaggagagaacgcggacaaaagtcaagcctttaggtcaggaagaaaaaattaaagaaatcggccgtatgatttcaggcgttgaaatgacagagttgacaagacagcatgcgaaagagctgctcgaactggccgaagcgataaaataagggtccggtccgcctatttggaaaaatggtggagccggaccctttctatccagattgggcagcatttttcccgcaggcgctgttatatttaaaacgcttcaaggctaaattaaaatcatagccaaaacaaacaaaggctaaacaacagggtgaaccggaagcgaggagagtggaatgtttgaactttgaaaaaataaggaagctgacaggcggatttctccttgtttcacttttattatgcgttttttcgcagccttttcaacaatatcttcactttccgaagcaagttcgcttactggaaggccagcaaatcgaatttcataaaacttctgctgccgctgtaatggcaagcggaaacagtgcggaaattcatgcgcatcaacatacggtttccataaaagggaagtcagccggcaaggaagaaatgtttcttaaactggcgggcatcccggtcaaaaaaacggaagtagaagtgcatccaaatattaagatgatccccggcgggcagtcgatcggcgtcaagctgaatacgctcggcgtccttatcgtcggccatcatcttgtgcagacggacaaagggaagttttctcccggtgaacaggccggaattgaagttggggacatgatccttgaaatgaacgggaaaaaaatcgaaaatatgtccgatattgccccaattgtccagcaggcaggggaagaaggaaaaccgctggatgccgtcattaaaagggatggacaaaccatccggaaaacgataaagccgttaaaagataaaagcgggcagtcgtataaactcgggctttatatacgagattcggccgctggaatcggcacgatgacgtttattgatccgaaaacgaaaaaatatggcgccctcgggcatgtcatatccgatatggacacaaaaaaaccgatcgtcgtcgaaaagggcaggattgtcaattcggtcgtgacgtcgattgaaaaaggcaaaaacgggagcccaggggaaaaattggcgcgttttaccgaagaaggccggatcgggaatataacgaaaaacagcccattcggcatttttggacagctggatccgggtgcaaaagacagcacatatgcaaaaccgatgccgattgcactgtcagaccaggtaaagacagggccggcaaaaattttaacggttgtcgacgggaaaaaagtggaagcctattcgattaaaattgtcagcaccattccgcaaaaatttccggcaacaaaaggaatggtcatcaaaattaccgacccggaattgctgaaaaaaacgggcggcattgttcagggaatgagcgggagcccgatcattcaaaacgggcggcttgtcggtgccgtgacacatgtgtttgtcaacgacccgacatccggctatggcgtccatatcgaatggatgctccatgaagcaggcatttacggagggggcaagtccccttccgcttttaaagaatgatgcacttatctattattaatgcgtgcggacgttttgtccgggcgattttccagcgtcccggttttcaacaaaaaataatgaataaaaaagcaggaaattttccgccattgtcgaaacatattcttgtacagagatacggctatttttttgaggaggacagtggcagtgaaaaaaatcagagtgtttattgttgatgacaaccgtgaacttgttcgtttattagaagattatatatcccagcaggaagacatggaaatttgcggaacggcatacagcgggacggaatgccttgaacagttaaaagaggcggacccggacattttgctgctggatattattatgccgcatctggacggtctcggcgtgctcgagaaactaaaagaatcggcttattcccggatgccgaacgtcatcatgctgacggctttcggccaggaagatgtaacgaaaaaagcggtggaactgggcgcatcctattttgtgctgaaaccgtttgatatggacatgcttgtttcacaaatccgacagacaagcaaaaaaggctccgtcctgaaatcatcacccggcatggcagcttccaaaccggaatcgaagcctgtcaatctcgatgcaagcattacgagcattatccatgaaatcggcgtgccggcccatattaaaggctatatgtatttacgcgaagcgattgcaatggtgtacaatgatattgaattgcttggctcgattacaaaagtgttataccccgaaattgcaaagaaatacaataccactgccagccgtgttgagcgcgccatccgccatgcgatagaagtggcatggagcaggggaaatatcgaatccatttccaccctattcggttatacggtttccatgaccaaagcaaagccgacaaactccgagttcattgccatggtcgctgataaactccgcctcgaacacaaagcttcctgaaagggaaaggggccggtgcagtgagttgtaccggccggattccgtgcgtaaaaggttacgcttttcttgttcggggaatatataatgatgaacgaaataaataaagggtgtgtatcaagtgacgcttatttttgcccaccggggatcggcaggcacacgtccggaaaacacaatggaagcttttttcgaagcggaaaaggccggagcggacgggattgaactggatattcagttgtcaaaagacggcgaactggtcgtcattcatgatgaaacggtcaaccgtacgacagaaggcaaagggtatgtgaaagatttaacatttgctcaattacggtcgcttgatgtgattgaccggttcgaaaccggcaaaccgctaagcatcccggcacttgaagaagtctttgaatggctcgcccaaaaccagcttctctgcaatattgaactgaagacggcaaaagtggattatccgctgatcgaggaaaaagccgtttcgttaatccgggcataccatttggaagaaagggtcattttttcttcctttaaccactattccatcattcaatgctaccgtctggcacccgaagtggagattgccccgctgtattcggaagtgatgtttatgccgtgggtctacgcgaaatcgatccgagcaaaagcgatccatccgcgccttttgacaacggccgaatggatcatccgtgccgccatgaaccacggtgttgcagtcaggccgtacacagtgaataaagcgaaagatatgagaaggctgtttaaaatcggttgcacggcaatcatcacggatttcccggaaatggcggtacaggaaagaaaagcagaacgggaaaaagcatccgggcaatagccggatgctttattttgatggtttgctgaaacgtttctgtaccttttggtgctttctgtcccggtgcaggataaatccggcggtaaaggcaatgccgccggcagagagcaaaagcccggtcagaaactggagcgtcagcgaagaaaacgggcggtccggaatcccgaaaaccatatcccgcatccatttgatcccataagcagcggcgatgaccggcaccgccaatacaaaaagtgccaccaacctgcccatcccggcccccctttaaaccgtttccatcattataacacccgggattggacgcaggcaatgcagcccattgtaaatgtaagccctttcaaataaaatagaatagcggagaccagcacgaaaagggggagcagcgatgcaaaatgttttaatcgttggcggggggaaaggcggaaaagcgattttaaaaatattgtccgagagcgcacggttccgtgtggccggcatcgttgatatcaatccgcaggcggaggggatccggcttgccaaaaacatgggcgtaaagaccggaaacaactggcgcgttttttcaggtcccgatgtcgatattatcattgaggtaaccggggatgagcaagtttttcgtgaaatcgctgccgattgcacgggccggattgtcatccccggcagtgtcgcctatttgattgcgaaattgctggaggaaaaagaagccttaatccggaagttggaaagcgaaacaaaaaaacatgcgctcatccttcagtcgacggcagaaggcatgacggtgattgacaaaaacggccggatcatttttatgaacagggccgcggaaaagatcaacggcgtttcggcccgggaagtgcttggcaagccgatctcaagcgtgatcccgaaaagccggcttgcccatgtccttgaaacaaagaaaagggaaacaaacgtggaaattgaactgcaaaacggggtcaaaatactcgcctcccacattccgatgtttgatggcgggaaagtcgccggggccatttccgttttccgggatattacggaagctgtgaaacaggctgaggagattacgaatttaaaagaaatcaagatgatgctgcaggccattatccactcaagcgatgatgcgatttccgttgtcgatgaaaaagggcgcggcatcctcatcaatccggcttatacaagaatcaccgggttaagcgaagaggaagtcatcggcaaaccggcaacagcggatatttccgaaggcgaaagcatgcattttaaagtgctgcaaacgaaaaaaccggtacgcggcgtgaaaatgcgggtcggtccgttaaaaaaagaagtgattgtcaatgttgcgccggtcatcgtcaacggcatgctaaagggaagcgtcggcgtgattcatgacgtctctgaaatcgagacattaacaacggaattgcgccgggcgagaaggcaaatgatgcaggctgccacggcaaaatatacatttgaggacattatccatgcttccgatgaaatggatatcgccgtggaacaggccaaactggcggcacagacacctgtgacgattttgctgcgcggcgaatccggcaccggtaaagagctgtttgcgcatgccatccaccaggcatccagccggaaaaaccataaatttgtccgtgtcaactgtgcggccattgccgagtcgctgcttgaaagcgagctgttcggctatgaggaaggcgctttttcaggcgcgaaaaaaggcggcaaaaaggggttgtttgaagaagccgaccatggcagcctgtttttggacgaaatcggtgaactgagcgcccatatgcaggcaaaacttttgcgcgtcctgcaggaaaaagagattgtgaaagtcggcggcacaaagccggtaccggtggatgtccggattatttgtgccacgcatgccgaccttgaaaaagctgttgcagaaggaaatttccgggaagacttatattaccggctcgaccgcatgccaatcggattccgccgctcagggcgagaaaacaggagattccgttactggccaggcgtctcatccaaaaaatcaatcaggattacggccggaatgtagaaggcatcacaagcagagcgctttccattctgtaccgctacgactggccgggaaacgtccgtgaattggaaaatgtgctcgggcgggccatcatttttatgggtttccatgaaaaatcgattgatgcggaccatcttgacgggcttggtttatccccggggaaacgcgcggaaaagcaagaagcggacggggtacccgaaaaaggcaacctcgatgaaatgctgtccgcttttgaaaagcagctgatccaaaaagcgctcgaagaaaatgccgggaacaaaacgaatacggccaaacagcttggcatttcactaagaagcctgtactataaattggaaaaataccggcttgcaaaaatcagcatgcaataatttgcatattcgtgcaaaaagtagcaaactggtaaacggaagtttatttttttaagccccgctcttttcgccatttctgcatgaaaagcggaaacaggaaaacaatgcgaaagtggcattctttttgcattttcaacagtgaaggctggcccggggtttcggaaaaagcggtgtgccgttttcaaaagaggcatcgggctgtccgttacagccgcaaaaatgcctgtacagctttctgacagctttgcttgcggaaaaggaggaagtccaatggaaatttttgattatatgcgaaaatacgattatgaacaactgttgttttgccatgatgacgcatctggattaaaagcggtgatcgccatacatgatacaacactcgggccagcgctcgggggcacgagaatgtggacttacgcaacggaagaagccgccattgaagatgcgttgcggcttgcgcgggggatgacgtataaaaacgctgccgccggtctcaatcttggcggagggaaaaccgtcatcatcggcgacccgcgcaaagacaaaaatgaagaaatgttccgggcgttcggccggttcatccaggggctcgggggccgctatattacagctgaagatgtcggcaccactgttgaagatatggacatcatccacgaggaaaccgattttgtgacaggcgtttcgcaaacgtacggttcatccggaaatccttcacctgtcacggcgtatggctgctatgtcggcatgaaagcagcggcaaaagaggcgttcggaagtgattcgcttgaggggaaaaccgtcgccgtccagggcgtcggccatgttgcatttgaactgtgccgctatttgcacgaagaaggcgcccgctttattgtgaccgatatttcaacggaggcggtaaaacgggctgttgaggctttcggggcaaaagcagtggacccggatgacatttacgcccaggactgtgatatttttgccccatgcgcgctcggggccattttgaatgatgaaacgcttccgcagctgaaagcaaaagtgattgcggggtctgcaaataaccagttgaaagaaccgaagcacggcgaccggctgcatgaaatgggcattctttatgcacccgattatgtcatcaatgccggcggggttatcaatgtggctgacgaactgcacggttacaaccgggaaagagcgatgaaaaaagtcgagcaagtctactataatgtacagaaagtgatcgacatttcaaaacgcgacgggattccgtcctatttggcggcagaccggatggcggaagaacggattgcaaaagtttcccgtgcgcgttcacaatttttgccgcacaataaacacgtgctcgaaaaacggcttccgcggtaacgcaagtgaaggaggaacaacattggcaaaagaatacgatgtcgttgttttgggcggcggaacaggcggctatgtggccgccatccgcgcagcaaaaaacgggttaaaaacagcaattgttgaaaaatcaaaacttggcggcacctgcctccataaaggctgcattccgacaaaagccctgttaagaagcgcggaagtataccggctggtccgaaaaagcgccgatttcggcgtggatgtccgtgatgccgccttgaattttgcaaaaatccgggaacggaaaaacgcagttgtggcgcaattgcaccgcggcgttcaatccttgatgaaaaaagggaaaattgatgtgtatgaaggcaccggcagaatcctcggcccctccattttttcgcccgtagcaggaacggtttcaatcgagggtgcgggtacagacaatgagatgctcctcccgaaaaatttaatcattgcgaccggctcgcgcccgcgtgtgcttcccgggtttgcagtcgacggggaatatgtgatgacatctgacgaagcgcttgaaatggaagaactccctgcatccatcctgattgcaggcggcggggcgatcggtgtggaatgggcctcgatgcttgccgactttggcgtaaaggtgacgatcattgaggcttccccgcgccttttgccgggagaagacagcgacatttcaaaagaaattacgcgccttatgaagaaaaaaggggttgccatcttcaccggtaccgcattcaatgcagcttccctccagacaggggacggcaaggtgcggatcggcacggaaaacggaaaaacgtttgaggcagataagcttttattatcggtcggccggctggccaacacggaaaacatcggcctcgaaaatacggatattgaaatcgaaaacggcgttattcaggtcaatgaagtttaccagacaaaagaatcccatatttatgcgatcggggactgcatcggcgggttgcagcttgcccatgtagcagcaagggaaggcatcattgcggctgaccgcatcgccgggaaaagcgtggacccgctcgatgacaccatggtgccgaaatgtgtgtattccaatcctgaaattgccagtgtcggcctgacggaagagaaagcaaaagaaaaaggatatgatgtaaaaattggccggttttcgttccaggcagtcggcaaagcgcttgtctacggggaaacggacggctttgttaaaatcgtggcagacgcaaaaaccgacgatctgttaggcgtacatatcatcgggccgcatgcaacagatatgatttcagaagccgggcttgcacgcgttttggatgcggcgccgtgggaggtggccatgaatatccatccgcacccgacgctaagcgaagcgattggggaggcggcactcgcagtagatgggcttgaaatccatgcgtagcttttggataaggagtgataacaatgaataaaaatcggcataaagacttaggtttaagcgaccgggaagtattggaaatgtacgaaatgatgctgcttgcgcgcaaggtggatgaacggatgtggcttttaaaccggtccggcaaaattccgtttgttgtctcctgccagggccaggaagctgcccaggttggcgccgcttttgcgctcgacaggacaaaagattatgtattgccgtattaccgcgatctcgggattgtgctcgctttcggcatgaccgcacgcgacattatgctttccgggtttgccaaagcggaagacccgaattcgggcggccggcaaatgccaggccactacgggcagaagaaaaacagaatcgtcacccagtcttcccctgtaacgacacaggtaccgcatgcggccggaattgcgctcgcaggcaaaatggagaaaaaggattttgttacctttgtcactttcggggaaggatcatccaaccagggcgatttccatgaaggggcgaattttgccgcggtccacaagctgccggtcattttcatgtgcgaaaataaccagtatgccatcagtgtcccgattgaaaagcagctcgggaacccgcgcgtttccgaccgtgcgatcggctacggcatgccgggtgtgacagttgacggaaacgatccgctcgctgtctatgaagtggtcaaagaagcggcggaccgtgcccggcgcggggaagggccgactttaatcgaaacgcttgtttaccgctttacaccgcattcttccgatgatgatgaccgctaccgtgcgcaggaagaagtgaagacggcaaaagaaaaagatccggttgttttatttagccggtacttaaaagaggcgggccttcttgacggggaaaaagaaaaagaaatcgatgcgcgcgtcatccaaaccgtcaatgaggcaaccgattacgccgaaaaagcgccgtatgctaaaccggaagatgcgctccggtttgtttacggggagtaaggaggagaacgatggctgtcatttcatatattgacgcaattacaaaagcattgcgggaagaaatggaacgggacgaaaaagtatttgtgctcggcgaagatgttggaaaaaaaggcggggtatttaaggcgacggccggattatacgagcagttcggcgccgaaagagtgatcgatacgccgctcgctgaatcggcgattgccggggtcggcgtaggggctgcgatgtacgggatgcggccggttgccgagatccagtttgccgattttattctgccggctgtcaatcagattatttcggaagcggcgaaaatccgctaccgcaccaataatgactggcaatgcccgcttgtcgtgcgtgcaccgtacggaggtggtgtccacggggcactgtatcactcccagtcgcttgaatcggtgtttgcaaaccagccggggctgaaaattgtcatgccgtccacgccttatgatgtaaaagggttgctgaaagccgcaatccgggacgatgatccggttctctttttcgaacataagcgcgcgtaccgcctgattaagggtgaagtgccggatgaagattatgtgctcccgatcggcaaggccgaagtaaaaagggaaggaacggatattacggtgatcacgtacgggctttgcgtccattttgccctccaggctgcggaaaagcttagagaggacgggatcgaagcacatattctcgatttgcgcaccgtttatccgctcgacaaagaggcaatcatcgaggcagctgcaaaaaccgggaaagtgctgcttatcacggaagacaataaagaaggaagcattatcggcgaagttgccgcgatcattgcggaaaactgcctgtttgacctggacgccccgatcatgcgtctggccggtccggatgttccggcaatgccgtatgcgccgacgatggaaaaatattttatggtcaatcccgaaaaagtcgaaaaagcaatgcgggaactggccgaattttagaattgcaggataggagggtgccaattggcgatagaaaatattacgatgccgcagctcggagaaagtgtgacggaaggaaccatcagcaagtggcttgtatccccgggtgatcatgtccataaatacgatccgctttgtgaagtattaacagacaaagtcaatgccgaagtgccttcttcgtttgaaggggaaatcgtggaactgatcgcttcggaagacgaaaccgttgctgtcggggaagtcatttgcacggtcaaaaccgcagccgaaacaaatgtccagcctgaagcagaaccgggtccgggttcggatgctgcagcgccacagccggaagcggaaaaagggaaaaaagtccgctattccccggccgttttaaaactgtcccaggaatacggcattgacttgaaccaggtgaaaggaacgggaagggaaggccggatcacgcgcaaagacctgttaaaaatcattgaaagcagggggaatgaggcggaaccgactccttcaaaaccggcaccttcaaaaccggaaccggcaaaaccggcacctgcccgtgaaacgccgcctgcttcccggcctttgcctgtacgggaagctggaaaagaagatacggtgattccggttaccggcgtgcgtaaagcgatcgcgaacaatatggcacgcagcaaacaggaaattccgcatgcgtggatgatggtcgaagcggacgttacgaaccttgtccgctaccgggatgccgtaaaagaagagtttaagcggcgtgaaggctttaacctcacatactttgccttttttgtcaaagcggtcgcccgggcattgaaagagtttcctgcgctcaattcaacgtgggccggggatgccattatccagaaacatgatgtcaacatctcgatcgcggttgccgccgaagacaagctgtacgtgccggtcataaagcatgccgatgaaaaatcgatcaaaggcattgcccgtgaaattgctgtcctggcgcaaaaagcccgcgccgggaaactcgccccggaagacatggagggtggcacctttaccgtcaataataccgggtcatttggttcggtgcagtcgatggggattatcaactatccgcaggctgccattctccaggtcgagtcgattgtcaaacgccctgtcatcatggaagagggaatgtttgcggcgcgcgatatcgtgaacctttgtctgtcgattgaccaccgcattttggacggacttgtctccggccgcttcttgaagcgcgtcaaagagattttagagacggtgacaccggaaacggcaccgctctattaatgaaaaatgcccgctgatgaagcgggcttttctattttggaaaatgtggcgatttatcaaaactgattgtttttgaacgattttaattgatttttactgtttttgaaggtaaaataacgaccggatacaccgcttgcaatcgcgcaggcggggaacgattgccatcaaaaaggggaatactaaaaatgatctccaaagcaaaggttgtgtaaaaaatgatttatacggtaacactgaatccgtctgttgactacatcgtccaggtggaacattttgaacttggcggattgaaccgttccgtgatggacaccaaatttccgggcggaaaaggcatcaacgtctcgcgcgtcatgaaaaggctgggcgttgattctacggcactcggctttctcggcggtttcaccggcagctacattgaaaattttcttaaagcagaaggcattttaacggattttgtccaagtttcaggcgacacgcggatcaatataaaattaaaatccggtgtagagacggaaatcaacggaacggggccttccatttcggaagctgagctggaccggctgcttgccaaaattgacagcctagggaaagacgatgtcattttgttttccggcagcatcccaagttcgctcccgccatccatttatgccagcctcattcaaaaatgccgtgaaaaacaaatccgcgtgatcgcagatgtttccggcgaatcgctcggccatgtcatcaaaacgggcccgttcttaatcaagccgaaccatcatgaaatcggcgaaattttcggcgtgaaagtcgaaacgcctgaagaagcgaaacaatatggcagccgcctgcttgatatgggcgttgaaaatgtgatcgtttcgatggcagaaaagggtgcgctctttttgaataaggaagtatcttattttgcgcaagcgccgaaagggaaggtaaaaaattctgccggcgccggcgattcggtcgtggccgggtttgtaagcgggatggcaaaaggaaaatcgtacaaagaatcgtttgcgctcggggttgcctgcggttctgcaacggcattttccatggaactgtgcacaaagcaagaagcaacatcgcttctcgaacaggtccatgtccaatctttataaaacgaaaaaccgggatgccccggtttttttgcataaaaaagggacagcgcataaggcgccatccaaagcatctagggagtttaggggtatggatctagatgtactgtcattttaccccgttttttggaaaaataaacgctttccggctattttttcgtttttacgcgtaaaataaaagaaaagggacggctgcaaacagaatatttgaaaagcagcgtgaaaacctgctatgattagctttaaagcagaatgaaaggatgagtggcatgtctgtcaattttaatctttatatgaatgatgtcgtgcgcatgtcccgtgaagaggcagtagaagccggctaccgggaactgaggacgccggaagaagtagacgaagcgttttccaaaaaagggacgatgcttgtcctggtcaactctgtgtgcggctgcgcagggggcattgcacggccggctgcggcgcacgccatccattatgataagcgtccggaccagcttgtaaccgtctttgccggccaggataaagaagcaacggcgagggcacgcagctattttaccggttatccgccgtcctccccgtctttcgctcttttaaaagacggcaagattgtgaaaatgattgaacggcaccagatcgaagggcatgacccggcggctgtcgtggccgagctgcaagcattgtttgaagaatattgtgaagaactgtaatgcataaagcctgtcccttccgttttggaaaggggcaggcttttttacaggggcgtgacccgggtgcaaagtgtgccttctgcgtaagcgcatcttccgcatgtatgaaccggcatgcgggatgcatactaaagaaaaatacaaccagcagcaggtgaatggcttatgcatatatgggtggcatggatgcttgttttcgggttatcggtatggccggcagacggacacgttgccccgggggatccgctcattattgtcaataaaacaacaaaccggcttgcttggatccgcggcgggaaaatccggctcgaaacgccggttgcgaccgggaaaacaaatgacctgacgccggaagggttttttacggtcaaagtcaaggcgaaaaatccgtattaccggaaaaagaatattcctggcggtgacccgcgcaatccgctcggctcgcgctggatcggttttgatgcgcgcggcacggacggccggatttacggcctgcacggcacaaacaatcctgcttcaatcggccggtatatttcaaacggctgcatccgcctgccgaaagcggcgctcgaaaagctgtacgaagaagtgccggtcggaacaaaaatttacatcacccggtcaacccggccgatgactgaactggcgaaagcaaaaggcgccatttaaaaaaggaacgcggactttcccgttccttttttaaaacagcattgaaaggccggaaagaactgttcctgccagcatggcaatgagcattaagtacacgacaattttctgcgtttttttcgacaaagcagacttcacctcttaaacggacggtaatcatttttattctagcctgaagggaagaaaggttaagaagatttattgttaacttgttgaaaaatcaagtggatgtgaaggtcattgcccaagcatccggcttgagtgaagatgagatcatgaaaatcaaaaggcagatagaaggggaaaagccttgaacccgagttatgacgaagcagagcaagtattaaagctgccgaattcttactttgatcgcgggtataagaaaggaattgaaataggagtagagaagggaagagaagaaggaagggaagaagaaagaaaagaattgttacaaacgattccaattgccatcaaaatgttgctggcaggtacggagcttcaattaattgtagaaaaaaccggcctgagccagacagaagtggaaaaaataaaacagcaactggagacaaagcaggacaagtattgaagctgccgaatttttattttgatttcgcgaatatatgaaataaaataaatgcacaccattgcgaacaggctgctcagggcggtagcgacccgcaatgcattgaaaaaacggccggcctgagtcagcaggggtgccgttcaagcggtcgttagcggggaatgatgtctgttacaatccggcaaatccggagagtggcaggcattttttcaggactgtgataccggcaaacggtaaatgtacggcattggccggctcgtgaacggatatgccgcttttttggtgcaagtttcattcctgaaaattgttttcaaaaaggaattgatcagcgactcgcgagcgttgaggtgttgctttgcgggaatttatagtaaaataaacttgcagctacataccggcaagttttttaggcttgccaccgtttccaccgttttgcaaaactcaattgtaagcacatacaggaggggaagaaagtggagtaccgaattgaaaaagacacactcggagaaatgaaagtgccgcgggacaaatattggggggcacaaacgcagcgcagcaaggaaaacttcccgatcggcggggaaaaaatgccgatggaagtgatccgcgcttttgcccatttgaaaaaggcggctgccgtcagcaacaatcgcctcggcaaattatcggatgccaaaatgaaggccattgtccaggcttgtgaagaagtgctggacgggaaatttgatgaacattttccgcttgttgtctggcaaacaggcagcggcacccagtcaaacatgaatgtgaatgaggtggtggcaagaagggcaaacgaaattctttccggagaaaatagtgctgaacacgtccatccgaacgatgatgtgaatatgtcgcaaagctcgaacgatacgttcccgactgcaatgcatattgccgcctaccatgaactacagacaaggctgttgccgccgctggaacagctgaaagaaacgctgcttgaaaaagaaaaagcatacatgaaaatcatcaaaatcgggcgcacgcatttgcaggatgcaaccccgcttactctcggccaggaaatcagcggctggcgtgccatgctggaaaaaagcgaacgcatgatcaaagaaagtgcaaaacatattttgaacctggcgatcggcggcacggctgttggtaccggcattaatgcggacccgacttttggtgataaagttgcggaagaactggaaaaacagaccggctacccgtttgtttcttctgataacaaattccatgcgctcacaagccatgacgaaatcgttcatgtccacggggcattaaaaggccttgctgcagatttaatgaaaatggccaatgatgtcagatggcttgcaagcgggccgagaagcggaatcggtgagattacgatcccggccaatgaaccgggcagctcgattatgcctggcaaagtcaacccgacccagtgcgaagcgttgacgatggtagcggtccaagtattcgggaatgatgccgcaatcgggtttgccgcgagccagggcaactttgaattaaatgtatttaaaccggtaattatatacaacttcctgcagtccgtccatctgctcggcgatgcgatgaagtcatttgatgaaagatgcgtgcgcggcatcgaaccgaatgtagaaacgatccgggaaaatgtcaatcgttccctcatgctggtgacggccttaaatccgcatatcggttatgaaaaagcggcccaaatcgcgaaacttgctttcaaggaaggtacgacgctgaaagaagccgccattaaaacaggttatgtaaccgaagaacaatatgaggagtggattgtgccggaaaaaatggtcaatttaaatcactgaaaaaaagggaggcgattgcccccctttttttcagccattttattggtttgttttattacgaatggaaagtaccaccaagttgttgttcagccatttgcacaaggcgttttgtaatttctcccccgacagatccgttcgcgcgggatgtcgtatctgcgccgaggtttacgccgaattcttgtgcaatttcgtatttcatttggtcgagagcctgctcagcaccggaaactaacaattggtttgaattgctgttgtttgccatctgtgtcatctcctcgttgtaagtttttggttgggtcggctggaattgcaccagcaagcggggaattccccgccaccttcttggttgaacccagcggaatttgatcgatgtactacgtattatggaggaaaaaattttaattatactggttcctggatggtaatcgctggtgatttttgcagtgaaaaaatgccggctgcaaccagcagccggcatttctattcacccaatccttaattctgtttcagcatcaaagaaatgggctttgttcatatcaagcccgagcgtaatttcgtcacccggtttgacaaccgtcctggaatcgatgcgggagataaactcttgcccgttgattctggaataaagcattgtttcagcgccatgaagttcggaaacatcaatcgtggctttgatggtagcgcccggcattgtctcaatgaaaacaggttcatcgtggatgtcttcggggcggacgccgaggatgacatctttcccgatatggcttttcaagtgtttcatttttccttccggcacatcaatctgaaccgattcgtttaagtggaatttgccgttatccagtttaccgcggaagaagttcatcgctggtgagccgataaaaccggcgacgaacaggttagcaggtgagtcgtatacttcacgcggcgttccgacttgctggatgacaccatctttcatgacgacaatcctcgaagccatcgtcattgcttccgtctggtcatgcgtcacataaatggtcgtcgtttgcaaacgctggtgaagccgggcaatttcggcccgcatttgcacccgcaattttgcgtccagatttgataaaggttcgtccatgaggaagacttttgcatcccgtacaatcgcgcggccgagggcaacccgttgcctttgtccgcctgataaagcttttggtttccgttttaaatattcttcaaggccaagaatttttgcggcttcctgtacccgcttgtcaatttccgctttcggcactttgcggagtttcagcccgaatgccatattgtcgtataccgtcatatgcggataaagcgcgtagttctggaataccatcgcgatatcacgatctttcggcgcgacatcgttcacccgtttgccatccatgtataaatcgccttttgaaatttcttcaagcccggcaatcatcctgagcgtcgtcgatttcccgcagccggaaggaccgacaaatacaatgaattccttgtcattaatatgtagattaaaatcggatacagcggttacattattgtcgtaaatcttataaatatgctcaagcgcaagttctgtcatcgtaaaatcctcccccgttataagttgtctttattataaagaaaaccctttcataatgggaacgtcaggatgcacaaaaaatgcagggcgattttcggcaccctgcccacacgattttcccggttgacgcagtgaaatgagagagccgggatcctggcaatgtaaaagcagctcgttttccattcttctggttgccgcattcattacaacatgggagctgatgccggcatgccactcttgatacaaccattttttgtaaaataggcctattccatctcaaggcagatcacgtaagacttatcggaagggttagccgccaaaggtttcgagacaggcgaaatacgcaaagatcgcatctgtaaaatgttttaaattcaaacccgttttttcttcgaatttttcaatccggtactgcaaggaattgcggtggatgaataattgttttgccgtcaggctggcattcgcaaaattttcaagataccgtttgatcgtttgccccatttcccggtcttcttcaaacagcccgtgcagggattgaaagagcaggcccttttcactttcaggcaaattagacagcaaataaaggggaagcagggaatgaaccgtgaacaaagcggacgttttccggcggcttttggcaaattcgaaaagccggcgttcgaatgagaagtggtgctttaatgctgccatttcctgaaattcgcctaaatacagcaaaacaggggtgtagaaatccccttcaaacgcacggagggatgccgtcagatcgtctttggttgcaattgtttcacttttttcttcaatcacaatgccttccagctgattggtcacaatcaccaagacatcaggcacaaacatgtttttgatagcttcctgaacgccggatacatccgaccctgcttttgccagcgcaaattgtgtaacgcgatatacgccgtcatggacaggggcatcggcatccggcaaaaacaggtagtcataccatttggatgcttcgctcgtcgtgccggcagtattttcttgaaattttgggaataatgtctttaacagcagcgtttcttccggtgtcaattcgaccggatcaatcccgaaatactttttttcttcttccatccaaaaccacaacaaaggtttcgccgcaatcggttcatttgcaatgcaagcatttggatacctcgtttttaatctttccagcatgtttggacccctcagtttttcattggatatagtctattttactcaatttttttaaagggagggaatcattttgccaaaaatccggtaacggcataaaacaaatcggcaagtttctgggtttttgctgtttcaatttcaggttcatcaaaggacattggtttcgcattcagttcaaacaaataaaagctgtcttcattgccgggtgcgatgtcagcggtaaattccccgaaaaagccgtatgattccgctaaagcattgccgcatgctgaaatgagcggcgcaagctttttttcaatctccgttttttcccgggaagatagcaccagcgtttccccgccctttgccgtatgggttgtcatgccgccggggcgggcaacccgcacgccgatgctggtaacccggtaacctgttccgtcgtaatggacgtggacacggtagtcatatttccgaccatcaagcaataatgttggcacggtttcttggacaatgtacgtttctttttccgcaagcaggccaatctcctgccacacatccgaaaagctggcgggcaagcgggcggattggggcgtgtaaaatgtccatgtctcacagggtccctctacaatgcggcggatgccgtatccttgcgaacgggcggcgggcttgatatagacatccttgtgcgtcaataaaaaagcgtgcaagctgtcttcatcagaaataagcgccgtttccggaagaaaaccagcaatcgccgggtcctgcttcaatttttcgtacacatcatatttatttaaaaaatgcgggttgaaaaaaggaatccttttttgccggagaagcgtggtgaagcggtggaaatcttcgcccgattcttcctcccgcttccggatccggttataaaccacgtccggaagcgggaacattgccctgtgccatttttcttgttttatatcccaaaacacaccggtaatatgtgctgaaatatcggcaaggctgaataaaaaagacagaccgccctgtttttcctgcaatgcttgttgaatggcgataaaaaaatcacgatctccgctgatggctttctttgatttactgataagtatcccgataagggggccggccgatgctccttttaacatcaggcggtgaggcgtttcctcaccgggtttcgcggagaaaggaatcagttccgcttcttttccccaaaaaagcggggacggggtagtgcgcttaaacattttttccttgcggtcaaaccagatgacggtcatgggaacatttcccctggtgactgcacctgccgttccgtcaaataaacggcaaatgataagctcattttgcgcgtcaataaatcgcacgccttcatgaacggatggttgaaaatggagcgcccgggctttgaattggcttcaaacagccatacttttccgtccgtactgatgccgaggtcaaacccgatttctccaatgattccttcgacatgttcatcgatggcacgggaaagtttgagggcggctgtttccagtgcatgccggtacatctcctgttgttccgggttttccgtaagctcgggaagtgttttaattaatccgccgcttctcacatgcgttgtcgggcttcccgggccggccacttttgccgcgattgctgtaacgacccagtttccatccccgtctttattggtatggacccggaaatcaaccggccgccctccgtctgttacgagaaaaatgccctgctggacaagcagccggttccattgctttttggaaaaaacacggttcattaagttttcaaggctgctgaattttaacaatcggttgccagtgtcccggtaccggcaataatacgcaccggaagcatggtggtaaaggatttgatggacgccgaggccaaggctgccattcaccggtttgatatagaccatcccgtagtcagacagcatccgttcaatttgatgaaaagaggtgagcgggtttgtttccggcaaatatgggcgcacatccggatcttgaaacagccgctcgttaatttctagtttgttgaaaaaaccgggattgtaccatggaatgaaatattcattttccaatttttctttaattttctgcgcatttacaagtttttcactcttccggttcgggagccggtcgtaaatggcattgggaaatggaacttcctgtttttcccagcccgctctcccgtaaaagtagccggtgatcacaccctgttcccaatctatatgctgttcgccgaataaaaacggcacaacaccggcgtccggctgggcggaaagaagttttgcaaaccacgctgaccttgcgccggccggccggttttcaaaaggggtgaagccggccgtaaaaatgccgacaagcgggccgagcattaggatatcgctgttttggaaacagtgaagaaccgttaaaaaggcgggcattctcagttcaccggcaagtgcgcttgagacggaaaaaacattgcggccatttggatgcggttcgatttttgcggcagcgatcttagagccgaaagccactttgtcggtgtgttcaagtatcggaaggctttgcggcgtgtacaggatcgggtcggatgcctcaaaaaactcgattttatattttctagccatttgcaaaacacctcgtttcattttcagcttcgtgctatacagtttcgatatttgcccgcgcgcagcttccggtttcctgtaaatgccggcagtaggcaagcggggcttcagccatttgcccggttttttccggatggagaaggctgaccattttcctgcccggtttcgaattgatgtcgagtatccagatcgattggtctcccgcaatgagcagatcgatccccagctcaaacagcggttgaaaagtttcttccaaaacagccggcaaggtgctgatgatgtcagagatttcctggctgatatagacgtgattaaaatgcggcgtttcgcgttgccagttctcgtatgttgagaggcttgcccctgcgctcaaattggttagaatgccgttttccatgccggtacggatgccccgcgccacttcctgccactcgccgcggctgtctttttgcaaaaagatgcggagatcaaaaggccggtttttccggtccatattgtcaatccttgcctgaatgagaaaatcatgctttccaagcagctgattgagccaagcttgaaattgatccaaacggtcgaagttccgcgatataagactgccgtttttcgtcgtactcacaagcagtccgcccgttctcttttcgagggaatataccgcataaccatgcgcaccgtttgccggttttaaaataatggaaaggtatttgttcagctcccgcaaaaccgttcccgtgctgtccgcctttactgtctccggcaaatacggagagatctccggaatttcctttaggcggtcataaagcatggctttattcggcagcccgtatccgagaaaggtaaggtctttccgttctttcagccatgcgacaatttttttggcatcttttgatggctggtcttcaccgtaaaagcagcggtcataaaggaattccggaatttggaaaacttcttctttccatatgccgcttgcagtgtcaaaatggagtccttttgctttctgcgtgccgggcagtaaatcaaggggggagaatgaataaagatcggtcccgtatttttttgattcatgtgccatttggtcaaaatattcctgccgggaagcaggatccagcgttagaatgcctaatttatccggcatgttccattcccctttcagtccatagaaataaaccgtaacggtaaagtgcttttacggatgggcggatgccgccgcgggatacgccaaacgcggccttagacggcttaacgtttgcttcaattacccacggttttccttcccggtccacgcctatatcgatcccgaattccgcaaaatgcccgtttccggcagaacagagcgtgatggcggcggcttccgccagctcgtgcatgagttccagcgcaagccggcctttttcctttccgaaatgatggaagatcagcggcgccggttttgccggaagccctccttgtgagaggtttgatacaatcgcatcatctgccgctgttcttgcgagggatgacgcgatctgccaatcgttttttgcgccggttctccagacaagaaaccggaaatcggtttgccttccatctgccgaaagcaatggaatgccttgttgaaggatatacggaaggtttccggtgagttggtccatttttttaacggtgtcttccacattttccgcaacttccggcaaactgttttccttgtgcgtattatggtcaaggaggaaccggccttcttttttttcaatccggatgatgccgcgcccctggcttccgttttcgggcttgacatacaggacgcttgatgcctcaagtttttccgcaaggcacgctggcccgtaccggcaagtttccggtaaatacggccgcaaaaatcggtttgcataaaggcattcgtaaacttccatttttgttaaatacttggcgttaaaaaaatcgattcccttttctttgtacgccgctgtttttttctcaaactgacggcttttttcagccagcctggagtgaatgcggttatagacgatgtccggttccggcacttcccttgttttccaacggtcgtcggaaaacgtgcagccggtaccggcacgggaatccaagccttctacaaaaaggtagccgccttctttttcgagcaggttgtgcagttcttcgcaaaatggccgaatgttttcggaaggggcacttccagtgagttctgttaggacggcaattaccgggccaagttcaagcgctccctgccggcagaaggctctcatccgtgcgggcggaacagggagcttcagatgtttgtaaccatccgcagagagcatcatcaccgttttgccggatgcatcggtttctacttttgccgtggctgtttttcccccgaaccggatggtgagctcgccgtttgaaatgtgcaaaaaggaaaggagcgcccgtggaatttccgccgccgcgcctttcgtttcatcatcatgccggaatgcaatggttgatgccaatccgttccctcccttcctcctgaaaacacgggcacgaacacggtccatttttgactttattgggcttttgctgatatcttatgattagtacagaaaatcggttcaaaaaaaatagctgattttagaaatacccggccgcaaaaaagggtattttttcattaagtttgcggttttccgcagcatagaaccaaaatcaacggttgtgtccgcatagcgggctggaaacttcccgtgcttctttggaaaaaatttcacaacgaaaacaatgagggatgattgtgtatgcatgcatttttggaaattttgtttatgactgtcgtgggggcagtgatcggcggattcacaaattatctggccattaaaatgctgtttcggccgtatgaggcgatttatattaaaaattggcggcttccgttcacgcccgggttgattccgaaaaggcgcgaagaaattgcgaaacagctcggcgaaatggtggtgcgtcatctggtcaccccggaaagcatcgaaaaaaagctgttgtcgcccgggtttcggaaagagacggcccgatggatgacggatacttttttgaaatggctggagatgagttggacagccccgcaaatggctcgtttttttaaagtggatttgtcggcggagcgtgtgcaaaccgggatcaaagcattcatccgcacccgttacgggcaggcaaaacaacatatcgcacctcaaacgcttgaagcactgctgcccgaagccgtgatcaaaaaagccgaagaaaaaatccctgttttggcggatttgatcattgcaaggattagtgaatacatttcgagccctgcaggccgcacgaaaattgaagggatgattagccattttctcgatgaccgcggcatgatcggcgcgatggtgaaacgttttatcggaaatacttcgattgccgataaaattcagcctgagatcatccgggcgctccaggaacctggaatgaaagcaaccatggcggaaatgctggaaagggaatggaacggcctgaaagcaaaacaggccggggaacttttgccggatttgccggatgaagaaataagcggatggctggagaaaaatgtattgtctctcctccctgtcgaacgttttttggacacacccgtccaggcatttgttgcccggtatcggaataaaattgaagaagaatggatccctgtattggcggaaaaagcgctgcaccttattagcgaaaacgtgcatttgatcatccggaagctgcaggtagcggatcttgtgcgccaggaagtggaatcttttccgattgagcgcctggaaagtctgattcttggcattaccgcccgcgaattttcaatgattacgtatcttggcgcgttactgggcggcctgattgggatcgttcagggggtgatcgtgctgcttgtataaaggaagcaagctccggcgcattgttggcataaggccggcctgatcctgcttttcgtgcaggaaagagaaaacaggaaacctatgtattccggcatttctgtgacaggtttcaggcggcccggccgctgcttgtgtaacgcgtcaaaaccgtgaaaccatccgtgacgaataaaatttgataaggaggagttatatgccatcccatttaaatgagtacgcgcgtatgcttgaaaaaggaattcgggaaagccatgaatttgctgcattgaagcaggcgtatgaaaatgtccggtcaaacggccaggcgagagcattgtttgaccgtttcaggcagcttcaactcaatttgcaagataaacaaatgcaggggcttctggttacagaagaagatgaaaaacaggcgcaggctgccatgcaagcggtccagtcaaatcccgccattatgcagttgatcggtgctgaacagcggctaagcgatctgctcagcgaaatcaaccaggtgctgatgaggcctgtcgaagatttgtacgccggaaaatagaagaatggagccggaaagttctatttcccccttttttctcatacatctgtaaaagaaagcaggctgtgtgagaaatcagcccggcagccgggagcatcatgaagagggggagcatccatgatctataaaatgctggcgttaaatattgagggaacattgctgcaggataacggccggctcggcaaaacaacgaaagaagcaatcgaatatgcaggtgcaaaaggcattgcggtgacgctcattacgtcaaaaaatttcgcttcggcccaccggattgccaaatggctgaagctgcattcttccttaatcacgcaccagggcgcttatattgccagtgaactggataaaccgatttttgtcagaaggatcagcgaagaggccacccgtgaccttgtgcgctttttggaagggtttcacgcccaaatccgccttgtttccgagcggtttacattgtctaacagagtgaagcatccgaataagttgatgggaaaagtcatttatcaaacgtccaatccgttttcttatgcagaacaatatgtggacgatttatcggcaaaactggaacaaacgccgctttccccgcccaaaatcgaagtgattttttctgacggagaggacattcaggcagctaaaaaagcgattgccaatatgttccatgaagtggattgtattttttgcggaaacgggaagctggatattgtgccggctggtatttccaagcttcgcgggcttttatatgtatgcgaccggatgaacatccgtcgtgaggaagtggtcgtaatcggttcgggccttgatgatctcccgcttgtcgagtgggctgggctcggcgttgcgatgggaaatgcgcatcccgctgtcaaaaacgtgtcagactgggtgacccgttctaacaatgaaaacggggtgtcttatatggtaaaagagcatttccggaaacagcagccaatcgactttttgaaaaaaatgaaactgctgaaataaggatggaaggggctgtttgctttaggcggcagcctcttttttttgatgaattttttaaaaagctgtcattttgtattggaaattgccgaatatttcgctatcctagtaataggaagaataaaacaaagggagagggatctcggtgatttcaacgtatgagacgatcaaagtggaggaaaaagacggggcggcctatttgtatttcaaccgcccggacgcaatgaacgcgctgaacttggagatgattaaggaactggcggacgcgttgaaagcgattgcgatgaaggatgacattcacattctcgtcttgtccggaaacggcaaagcattctccgcaggcggggacattaaagccatgctggcgatggaagaagagaaagggttcacctcttttatgaaccaaataaatgaagccgtttccattcttgtgggcatgccgaaactcaccattgcggcgattaatggagctgctgcaggattgggcttaagccttgccctagcctgtgataccattatcagtgatttggacagtaaaatcgcgatgaacttcatcgggatcggccttgtgccggacggtggcggccactatttgctgcagcgccggatcggccaggaaaaggcgaaaaaagtgatttgggaaggaaaagtcatgtccgctgaagaggcagccgaaacgggcattatcgatgaagccgtgcccgatcttgcgcttgccgttgaccaaaaaattacagaatggcagaaaaaaccggtcctcgcgatgatcaaaacgaaaaaaatctatacggaactgaaccgccctgatttcaataaatcattggaactggaaaaacatgcacagtggaaaatgcgccagacgaaagaccacaaggaaggcatccgcgcttttgtagagaagcgggcgccgcaattcaaaggggagtgaaaacatgcgcgactataaactgactgcctttgaaccgacaggagaaaagattctcgatgaaggttttgaagcacaggatgatacggaagcgaagaaaaaaggggaggcgcttttaaaagaaaaaggcgtcgatgagaaaacgcaccgttgcgtatcccctgaaggaaaactgattttgttccaccgctaaaaagaacccgggccaacctagcccgggttcatttaatgggaacggcgcatgcgcttgccattaatggatatggacacgctgctgcacatcctgctttacatccttttttatatcccgttttacttgcttaacctgctttaccgccgccctacggttcgaaagccagccaaggaacaacaccaaaaccgtaagaatgccgccgatcgtatacgttaccggcccgtgtgagatattcaaccatttcaggatttgttcatctttaaagagcatttctgctgccgtccaggcgaggatgccggacccgacataggcaatccagctgtaacggttcatcgcttttacaatcatctttgaaccgaagatcatgaccggaatactgatggcaacgccgagcgcaatcatgccgatatgcccgtttgaagcaccggccagcgccactacattgtcaaggctcataatcgcatcagccataataatcgtaccaatcgaaaccagcagcccattttttgctctgacgtggacattttcatctccgccgccgagcactttatatgcgatccatagaagcaaaagcccgccaatgacatttacataaggaattttcagcaaagcaacgattgccattgccagcagaattcttaaaatcaccgcaccggctgtcccccagaaaatcgctttgttttgttgttcgcgctgcagtttccgggttgccatggcgatcacaaccgcattgtcgcccgataaaatgatatcgatcataatgatcttaagcagcgcaacaaaagccccggcagaaacaaccaacccaaagtcaaatatagataccggcaattgcttcattcccttcacgttctcaatactagttcatttgacactatcataacacagtccgacccgaaaagtaatagaatcgcatcgatttcatcaaattggaaatcatttttttccatcgtttccctgcttacccgccatttcctggttttcttcatttacgccaatgaagacttatagtatccttattgggagagttttttgtgagtgtgatagaaaaaggagtgcgatatgccgttatgggccagtccttattgcaaatgaataccatttttatcagcattatcatcgaggcgttgccttttattgtgctgggtgtgttcatttcagcggtgatccagatgtttgtcactgaggaaatgattgcaaaagttatgccgaaaaaccgctttttatccattgcgttcggcaccgggatgggcgcgctttttccagcctgtgaatgcggcattgtcccgattacggaaaggcttgtccggaaaaatgtcccgctttctgccgccatcgcttttatgctgacggggccgattatcaacccggttgtcattttttctacgtttgtcgcgtttggcgattcctggaaaatggcactgcttcgctgcggactggcgatttttactgctgttttaaccgcgattgcgatttcatattttttttccgaaaaccagcttcgcgaatttgtggaggccaaattgcaccaccacgggcatgaccacgaagcacatgataaaccgaattttctgcaaaaaatcaccggtacgatcgaccatgcgattgatgagtttttttccgtcgggaagtttctcgtgtttggcggcctgatttctgccgcaatgcagaccttcttccggacgagcacgctgctgtcgctcgggcagacaaaaatggcggcgattctaattatgatgctgcttgcttttattatgtcgatctgttccgaggcggatgccttcattgcttcgtctttcaacgggatgttcgggacgtcggccatccttgcgtttttagtatttggcgcgatggtggatataaaaaatctgctcatgatgatgcattcctttaaaagaaaatttgtcttttcgatgatcgggctgattatcgtttttgtgtttacgggtgcattcttgatatagaaggtgtttaaaatgttgcgatttatcgttttgttcggcttcgcgtatttttttatgaagctgcacgcgacaggagatattagcaaatatattaatatgaagtatgcgtatttgtcgttttccatgatttttgcgatgggttttttatgtttgtaccagctcgtgaaatgggtcagggcgggaaacgaggcgcatgaccatcatcacgccgcccaccacggccattcgcatgaaacggatgaaaatacatggtacaaaaaaatgtttacgtacggtatgattttaatcccggttgtaacgggcatttttcttccggtggccaccttgaattccaccgttgtcaaagcaaagggcttccacttttcgatgattgacaatgacaaggaccaatatgccaatcaccagattttacggccgaattccagcctttactatgataaggaccagtatacagaaatggaaagttcggatttgaaaaagtacagtaaattgcaaagcatcgtcctcgatgatgaccattatttccacgggcttgaaacgatttataattatccggggaattttatcggcaaaaaagtggcgattaaagggtttgtctaccggacggatgatattaaagcgaatcagctgtttgtgctccggttcggcattatccactgcattgccgatgccggcgtatacgggatgctcgttgattttccggacaatatggcaaacgtgaaagaaaatacatggattgaggttgaaggaaaactggatacgacgtactatacgccgtttaaagagaatatcccgtatttaaaagtaacaagttaccataaaagcagcgagccgaaagatccatacgtataccggcaatacaattaaaaaggtttggcatgttcagccatttttttgttgcctgaacgtgccaaaccttttataatgaagatagaacatatattctatgaaatgcgtttgattacgaacaggttggatttcacaaaaaatggaaaaatgccggttatttttttacgaaagagggatgtcgttgaaaaggattcgctttgtccatgcggccgacctgcaccttgacagtccgtttgcggggctccgcaagcttccgccggcgctgtttgaacgggtaaaggagagcactttccgggcatttaaaaatctatgtgaccttacaattgaaaaagaagcggatttcctgctgatatgcggggatttatacgacggggaagaccgcagcctgaaagcccaggtgaggctgaagaagcagtttgagcggctccaagaggctggcatttccgtatttgtgctgcatggcaatcacgaccatctaagcgggtcatggacaaaattggacatgcccgcaaatgtccggatattttccgagcgtgttgaagccaaatcttttacagctaaaaacgggtcgaaagtccatgtgtacgggttcagttacccgaagcggcacgtgctggagaacaaaacggatgaatacaggaaaacaggagatgctgattttcacatcggcatgttgcacggttaccttgaaggcgggacgaaaatgcaccagccttatgcgccttttgccttgcaggatttgctggaaaaagggatggattactgggcgcttggccatatccacaagcagcagattttacatacgcatccctatatcatttatcccgggaatattcaggggagaaaccggaaagaaacgggtccgaaaggctgtatggttaccgaaatggatccgcttggtacgcataccgcattctatgagacggcggacattttatgggaaaaacgtaccgtttccgtaaaaggcgcaaatgattttaatcgtctgtacacagtttgccgcaatgcccttgaagaagaaaggaaagaggcacagggcgtatttttgcaattggatataaaagatccggatctgctcgatgatgaagcgcttggaaaagtgaaaaacggcgaactgatggaagtgctacaggaaggcgaagaagcagaccgcaattttgtctgggtacaccgcatcacactgcctgaagatgcctttgtctccgcacgggatgacggctttattttgcaggaaatgaagaaaacgctggcacaattggaagaaaccacagtagatgaagcggtctccccgttgtacagccatatggttgcgggccgctacctggacttggacggagatgaaaagcagcggcttctgttggaagcggaagcggctgtttttgagaagttgaaaggcagggggaaacgatgaaaatacgggaggtccatatttacggttttggccggcttgttgattttcatatggaaaatctttcggatctgcaggtcatttacggggaaaacgaagccggcaaatcaaccttcatggcttttatcgaagccgttttattcgggtttccttcaagacagcaaaacgggcagcactatgagccaaaattttcaccggtgtacggcgggaggcttgtcctcgaaacagaaaaagacggaaaaataacggtggaacggataaaaggaagagcagccggagaagtgtccgtcacttttgcagatggcagaacaggcggcgaagaggtacttgcacaagttttaaacgggctgaaccggcaaatgttccagtccatttattcttttaatctgcaaagcctccaggaaatccgcaaattaacaggcgatgatatcagccgctatttatttgctgcagggacaatcgggacggatgcgctgctttcggcggaacgggaactcgaaaaggaaatggaggcgcgttttaaaccgaacgggcggaagccggtcttgaacgtgcaactccggaaactgcaggccatggaaaaagaactgaatcacctgaaagcggaaaacggccgttatggcgaatggaaagcccggctggcaacgattgaagcagcacaggaagaagcggaggcggagctggaagccttaaggggaacggttcagcagtatgaacatctcacaagcctttggccgctttatgcagaaagaaagcatatcaaactgcagctggcggaaatcggtcccgtccgctttcccgctgacggaatccggcgcctcgacgcgctgatgtcggaatggcgcgcttctaccgggcgcctgtcagccgttaaaaaacaaaaacaggtactggtggaaaaaatggaaggagagcagccggatccgcttttcgtccggcatgaaggggagattaaaaagctgctcgatgactggccgcaataccgcgggtggcaggcggaagcagagcgccttcaatctgaacgcgaaatcctagacagccaaatctccgaattatcgggcatgctgcatcttacggcatcgcaagttgaaaaagtaccgcagcttgacttaagcattgcggcaaaagaaaggctcagcacccttatcaaggcgtatgaccatcaccgttcccgcaacgatgctttacaggcacagcttgaggacttgcgggctcggatgaatgctgttgagcagcaatgcgcacttttggaaaaagagctcgtatccgaagaggcttttcgcgatttatcggcaaagcggcaggaaaaggaaaaaaaatcattgcttgaagccgatatcaggcgcgggaaacagcagctttcccgcctgaaaaaaatggcggatgaggcccggaagcccccggtcctgttttttggccttgcattattgtttctgatggccggcgtgtggagtttgctcacagggcaatacctgtttctgggcgtttttgtgcttggtgcaatcgtgtcaggctaccatgctttgaagggaaagcggaacccgtttgaagaagaaatccgagcgctcgaacaggaactggaggaagaggaaaaagagctgcggaattggaaagacggggacacggattggcatgagtatgaacggcagaaacagctgcgcgaaaactggaaacagctcattctgaagcttgaggaaggcgaacagaacggccggcaaatgcaaaaccggaagcagcgtctggaagcggaagaaagacagctgctggcagaaatcagccatttcaggcaaactttgcaattgggtgatggcttccggcccggacagctgcccgatgcgttccaacttttgacggacttaagcgggaaattgcgcgagcggtcgcgtatcgaaaagaaactggcgcagctttccgcctctcagtcggcatttgcagaaaggatggaaaacctgtggtcccggctccacgtcaactggccattacgccaggagggtatcttgctgttgcagcaggcgtgtgcggaacaacaggaaagaaaaatccgcctgcaggaatgggaaaagaaatgtgccgagctggaagaacaattgcagctgcttgaatcggaagcggaagcaacagataaggagattaaaaaactttttgcccttgccggtgccgcgaatgaggaagatttccggaaagccggtagcctttttcagcaatacgaaaagttgaccggtcagctcgaaatcatagatttacggatcagccgggaagacctagaacggctcgaaaggatagaagatgtatccatatttgagcaggaaaagcaaaagctggaagagaaaattgcggaaaaggcgaacgcgcttcgcagtatgagaaaagaagcggcggaaatccggtttgaactggacaggctggaaaaaggcgggacgtttaccgaaaaactgcatgaatattacagcgcgctttcagatttccgggaagaagctttcgaatgggcacggtttgccacggcgaaacgtttgctttccggcatgatgaagcggctccgggaaacccgctttccgcaagtcctgaataaagccgaagcgtatttgcaatctttaacaaacggatcgtatgtctccctccatatgggcggggaggatggccgtttttacgttaaacggcgtgatgatgtgctgtttgctgcaaatgagctgagccaggcaacggcggaacagctgtatattgctttgcgtttttcccttgcggaggcgctcggcggagaattcccgtcaccggttgtcattgatgacggttttgttaattttgatatttaccggacagagaaaatggcccgcttgctcgaccaggtgagcgaatcgaggcaggtgctgctttttacatgccagcagccgatgctccggttttttaaaggccatgaggtgaaaaccttgggggctatacacggtcaagagctgacaggttctggaaacatcagccgtattcagccgtaaataagaggggcgggccgaatgtctgtatttcgacacggtggtgaaacgcacaagcagtaaaccagtttgtcctggccgtagtcgtctttttcctaatttcaacacggcggtgaaacgcacaagcaaatccggtttagatcaaaagcggattccggccggattatggtatactttaagacaaatcaatcaggggttagatcggaggattattatggcaaaagggctactctactatgaggtgggcgaacagtttgacgcgtttttgctcatcaaacacgcaacaaaaggaattgcgagcaacggcaaaccttttttaacattgattttgcaggaccggaccggggatatcgaagcaaaactctgggatgcgaccgaacaggacgaacaaacatataaaccggagacgattgtaaaagtaactggggacattttaaattaccgcgggcggctgcagctgaaaatccgccagatccatccggcacaaccgggggacggtgtccggatttccgattttatcgaaacggccccgttatcgcaggaagaaatgatggggaaaatcacccagtacatttttgatatgaaaaatccaaatatccagaggctgacccggcatctgctgaaaaaataccagaagcggttccttgtctatccagctgcaacgaaaaaccatcacgaattcgtatcggggctggcgtaccatgttgtctccatgctcgaccttgccaaggcaatcgcgggcctttatccttcactcgaccgggatttgttgtatgccggtgtcattttgcatgatttgggaaaggtgcaagaactgtccggcccgatctcaacaacttatacggctgaagggaatttgctcggccatatctcgattatggtcacagaaattgcaaaagcagcggaggaactcggaatccacggggaagaagtcatggtgctggaacatatggtgatctcccaccacggaaaagcggaatggggaagtgccaagcccccgatgattaaagaggcggaaattctccactatattgataatattgatgcgaaaatgaatatgcttgaccgtgcgctccgcaatgtcaaaccgggcgagttctcggaccggatttatgcacttgataaccgttctttttacaaaccaacgtttcatcagtgagattcatagaaacgcaaacgtttggaaagcgcccgtctggtgaaaaacttttaaaatgcctttcaaaatgaaaggcattttttaatggattctgccatacattatagcagggacaaaccgaaaaggaggggaaaacatggatttcccaatctggatttattttgttgtggcaggcattgtcatatgtgcgtttatggcggtgaaaacagcccgggaagaacacgaacaggaacaggaatggattgaaaaagaaggggaagtttttattgaaaggatgcataaagaaaaagaattgcgcagcggtgaagctgaaaaagcccatgaagcataacggccgtaaaaaaaccgcccctaaccggaagggcggttttttgcggcattatttgcttgatgaagtcccaagcagggggtcaaaagttgttttcaaatcttcatcttttacttttatgtcagccgcttttaattctttcttcaaaacggactggattttttctgttgtcacttttgattctttatattgtttgacgacgtcttttttcatttcgctgtacggttttttctgtttttcgccggtcagctgaataatatggtagccgtaagaagtcttaacagggccgctgatttcattgactttcagtttataagcagcattttcaaaatcgctgtccatttcgcctgcaccgaaccagccgaggtctccgcctttagaagcagttgcggtatcggttgaatactttttggccagcgttgcaaagtcggcgcctttatccagttgtttcttgatatcttccgctttcgacttgctggaaacaagaatgtggcgcgctttgattttcggttttatgtcattgttataataattttttaactgcttttccgttggatgtatggttgcctctgccgctttttgttcaagcagtccgattttcacactgttgcggaaatctttttcatttgcataaccgtattgctgcagcgctgtattaaatgagctgcccaattgtttttttgtatcgtttacttgtttgtcaatttcgctctttttgacagtgtattttttggaaaggactttttcaatggtaagctgctggagcacagttgaaccatatttatccttcattgcattatataactcgtctttggtaacatttccggcgttcgtcttcacgacggcgctattgccgctgttgccgcatgctgcaagtccgaacatgctgcctgccaaaacaagggatagtacccatttcttcattcaagaacaactcctattcattttgtcttgcaagagagatttacaaccactactataacataaattgaaagagaaaagaaagggattgccgggtttcttatggaattttcacaccatgccaatcttcttttcatatggggcaggcgtttgtagaaggcaggatggatgtttgctgcatatgatattgcatggggttccattgtgaatttgtgaaatttaggccggcaaatagacgggtgccttaaccaatacaggggtggatgaataatatactgatgaaacaagaggaggtggatggaatgagcggaggagcagcttacggaggcggctttgccttgctggttgtgttgttcattttattgatcattattggtgcatcctgggcttggtaaaatttggggtcggcagctgccggcctttcttgttgtgttgttattgagtgccaaggtaggaggaaaacagtaaaatggtcatgaggatgttgatcgtccgaaaaactcccggccggtgttcttccggtatttctttttttgtacatagatggcttgtcaatacgttgataaagtataatataaagaaagcgtaactgtaaaaaaaacaagcacatacatgccggccggcccccctcccgaaaatttgcagtaaaataaaggcggagcgcgccggtttagaatctgggttcgtaacgttccgcctgtctttcggatggcaaatgtgtaatgcacgctggtcttttccatgcaaggtggatgaacgattattcatttttaacaggcactgccttgaaccgctcgtggcgaatgccgcggggaagtttttaaaggccggccggacaatgggccttgccggaaaacacgcccctgtctaaaactgaagcatcccatgaccggggtcgcgctgttctcagcagaatcataaaaacatataaacgagggaactgaatggaatcgattgaacaaaagctggaaagactggaattttatcaaacattgcttttaaaaatgatcgggaccagccaatatccgtttttcaggctgattatggaaaaacagctttcaaaacaggatattgaacaattttatgcgctgtgcgatcgtttgagcgatgagctgaaagaacagaaggcggacaaatttgtatatttttatccgctttttcaaaagtttaaggaatccctgcatgaaaaactgcagccggcggaagtgattgccgcctgtttgcaacaagggctgtatcctgacttaatgaaggcattgaaacggaatttgtagctgcccgaaacgggtcagaagcggttcagcgaaggttttcccaacagttccgtttcaatgacatcatccagctccccattgaaaatggaattttctacaatgtccataaaatcttgaccataaatctggcgtacgatcgcagccagttccatcatgtccggaaatttgccgtaaagatcgtaaagcggcatcgtgccttgtacgacggtgctttttttcgggttaaacgcttccaatgactttaaaaaaatctctcttcctttattagttaattgaatatacgtgttccgcttgtcgttttcctttttcgagaattcgagcaagccgcgctcctcaagctttttcgaaaaattaaaagctgttgatacgtgcatcaccccgaattttgccacgtccgaaatcgatgcgccctttaaatgataggcaatccataaaatatgatgttcattgatgttcagatcgaaaggcctaatccattgctgccagtctttttcaatcgttttccagagcgctttcgacaattgcgtgacccttttgcaaaatagaagatactcattggtcgtcaacatttgttccgtcatatttttcccatcaccccttaccctatatattatcattatgccagtaaaataaaaagtaataaaaaacaatttactaaatttttttgaaaagaatagcaaagaaaaagcccggaaagcggttgttgctttccggacagcgaaaagtcaggaagattttttctccatttgttgttccatgttttcaatcgttttccggatttctttgatttcattttgcagggcgtctttgtttggctcaatgcttttttgccattcttcgatacagtgttggatttcttccattacgttcgtggcgacttttttgccttctattgaaaaatcttcgacggatgcttttaagtcttttacattttcggcgatccttttggccgattcaatgaaatcaccggaattatttttgatggcttcccgtattctttttccggaagcgggtgtggtgaaaaggacggaaacagcgcctgctgttgctccaaccagtaatccgtaaaataaactggatttgttcatggaatgcacctcctggaatggtcttttatcctcatgatatagaatttgccagtcttttgcaaagttctctttcttttttgccgggctcgtccaaagcgatattccaagcttgaccgcggattgtccttcacgggcggtatgaaggacaaaagagcggacgccacgcatccaactgtctttcatcagcccgatgaaagacaaaacctggcccccgtgccgtggaattgtccttcacaggcggtatgaaggacaaaagagcgggcggcatgcatccaactgtctttcatcagcccgatgaaagacaaaacccggcccccgcaccgcagaattgtccttcataagcggtatgaaggacaaaagagcgggttcggcgcgtgcctctgtttgttctttacccgcgtctggtacatgttaatccgcatcagggcatatgatgtaatagtccaggcagaaaagagggggagttcgttggggcgtgttgctttctgctttttaatggccggcgttgtcctgtttgccgcgatggtccggcacatgctgctgtaccagaaaagaagaatttatccgccgcggaaagtcataagaaaaaggattgcatttttcggaacggccggaatggttttcctgcttctcgccgctctgtttcatttattttaagctgtgcaagcgaaaaaaaccgccggaaacccggcggccattttcacgcttgcatgctgtgggcggcatttgtgcgctttgcaacgtttgagatgatcggaaaaagaataaacatcgcaactgcattgagcacggttgccggcaaaacgacggtgccaaacaaaatggcaaaaggccctggcaacccggcaataaagaacgcggatcctaagaaaatgatgcctgaaatcagtgtgccaatggccgtgaatacaatcagtgccggcagcttttttgccagttttccggaagcgagaagcaaaccgtaaaaagcaaaagaagtgatacatttatcgatgatgttcgggaaaaaaccgcccgggaagctggtggtcaggccggaaatgatgccggtcagtacaccaagcaacagtacgtattttttctccttgaacaaaataatgccgataaacatcatagtaagcatcatatccggtttcatcccgaacacgaagcccggaatcaccgtgtgtaataccgtgccgatcccaacaagcaacgccaagctgacaagtgattttgtcttcatctgtctccactctcctattctcatctcatctggtgctttcccgacgtaccctcatggccggcggcgaaagattaaccttattatagcatgcagccggaaaaagtgacgcatgttttgatcaaattgggcgcaacaaaaaatggcagcccaaatggccgctgaaaaaaataagcgcgaacccggctgcaaaaacgcaaaagtgggcttattcagtggcactacccggtgcaacttatatttttttggaaatctccgcggcgatttgctggaggtcctcctggctgtaatctttttcatgtgttttccagactgccccgaagccgtctccttttccatatcgcgggatcaggtgcatatgataatggaatacagactggccggcaatctcgccattattgttcaacacattgagccccacaggctggaatgccgctttcaatgcattggctacgacagggacggattcaaagaaattgcgggcaatctccggcgtcagttcgtagacattctctttatgtattttcgggacaatcagggtatggccctttgtcacctggctgatgtcaagaaaagcgtatacatgctcattttcgtacacttttgcactcgggatttcaccgtttataatcttgcaaaaaatacacattttgatcaacctttccatttttttgatttcattataacggatgaaaaggcgaaagaaaaggaaacggggcggaaatctgcgtttccgccccgctctgcagggtttttcaactagccgaaaagcacctttgatcaacacttcatttacgaatgatatggttgataatgggcttcctcaactttttccaacgcgatcatccccttattgggtaacgtttaaagtgcatcacctttaaacagattcaccgccagcacctcatgaaaagggtgcctggaagtcggttatggctaatgtaaagcatcgttactggtctttgacaaccaccccgattgcttgtttttcccctgcaagtataggatgggcaaatggttggaatctatacatgcgcattgcaaaaatttttcaggcgcgcagttggcattcagtcacgaacgctttcatggtacaataaagggtacagatcagaacttttgacataaaggggttctttagatgacattattggaagtggcgtccttaacaggtggatatacgaaaaaacctgtgattcaagatgtttcatttacagtagaagcggggcagctgatcgggctgatcggcttaaacggcgccggaaaaagtacgaccatccggcatattatcgggttaatggaaccgaaaaaagggcggatcacgatcaacggcaaaaacttaaacgcggatccggacgcttatcggaagcagttttcgtacataccggaaaccccgattttatatgaggaactgacgctggaagaacatttaaaactggcggcaatggcatatggcatcgatgaaaaaacctatgcggacagaaccgcgcctttattaaaggaattccgcctgcataaaaagctcggctggtttccggccaatttttcaaaaggcatgaagcaaaaggtgatgattatgtgcgcctttttagtccagccgagcctgtacattattgacgagccttttctcggcctcgacccgctcggcatccagtcactgctggatttgatgggcacgatgaagaaaaagggggcgggcatcctgatgtccacccacattcttgcaacggcagaacggtattgcgacggattcatcattttgcataacgggcggatccgtgcgaaaggaacattagaagagctgcagcagcaattttcgatgcccggcgcaacattggatgatttgtatatccaattgacaaaggaagatgacgatgaacgaaattgaccgcctttggaaagaaagatttgcttcctacttacaaaacctaaggcgctatacacggtatatttttaatgaccatttgctgtttgtgctgattttcgggctcggtgccgccgctttttattacagccgctgggtgaagcatctcagtccagattttcccgttgcccttgtaatgggccttttgctcgggttgtttctggcggcgagcccggtgtacacgctgttaaaagaagcggaccgggtgtttcttatcccgatggaaatgcggatgcgcccgttttttaaaaaagcgatcctgttttccttcagcattcaggcttatctgcttctgtttgtgcttgccgctttgatgccgatgtatgcggctgttacggggcacggattcggccgtttttttggtctgctgatcctgctgctcgtgttaaaaatgtggaacctgcttttgagctggaacgtgtataaactgccggagccgtatgcccctgttttcgactggatcatccggtttgcattaagcgccgcgtttgtgtttctcgttgtcaatgaggcaaacctctttcttgtggtcattctggctgtcgttatgctcggcttgtttctgtatttttaccggctcgcccaaaaacggacactcagatgggatgcgctcattgaacgcgaagaaaggcggctaatgggtttttaccggtttgcaaatctgtttgccgatgtgccggaactaaaagggcaggtcaaacggcgcaaatggctcgatccgctcctcgccggcatccggtacggccaggaacatacgtatcaatacttatttgcccgcacgttcctcaggacaagccagtatttcgggctttttgtccggctgaccgcgatcggggccgtgctgttgtttttcagccatgaacgggtgctcacgctcgttcttgccgtcgtgtttatttatttgacagctttccaaatgatcccgatgatcggctcccacgatttaaaaatctggctacgcctctatccggtgccccgcaagttgaaagaaacgtcttttatccggctgcttgcagtctgcctgtatgtgcagacggtcatttttgcagcggcggccgcattgaacggcttgtggatgaacggtcttttcgtccttgtggcaggcgctgtattttcctggctgcttgtcgcctggtatgtccccggaaaaattcggcgccagtaacgccggcgtaaatttaaaaatggcgcaggctctccatgtaagcggcggttcagttggcaagtggcagcctgctcgtaaacatgaaaaacggcacaagctggagagcctgtgccgtttttccatgtccgaccgccccatttgaatgcgtccgtctatggcgttttcagccactggccaaaaagccgccccttgtctttagagattgcaggcttttgctgaaaaaacggaaccccatgcctgcagcggtttttcaaaacgcccggattgccggggaaaataaaaccaggccggcaacgttgatgcttgagcattttcagacgttctggtaccggatggctgctgcacccaaagttttggcggcaataagcatcgctttttcatggatgtcaaagcgcggatggtgatgcggataggccgggtcggctttttccgggtccgcccctgtaaagaaaaagacgccttttacatgctgtaaataataggcaaaatcttccccgatcattgacgggtcgacttcttccacattggtgacaccttcgatttcttttgcgcagtcggccaaaaatgctgtttcagcctcatggttcacaaccggcggatatccgcggaaatagtgataatcatatgtgcagtccgccgccaggcatgtgccttggatgatcctttcgatttctttttccaccctgtcccgcacatcttcgtcaaatgtccggaccgtgcccgtgattttcgccgtatcggcaatgatattgaaagcatcgccggatgaaaaggacccgaccgttaaaaccgcggaccggatcggattaatccggcggctgatgacttgctgaagattcgtgacaagttgcgccccgactacgaccgcgtctttcgaaagatggggctgggcgccgtgcccgccatggccttggatcgtcacttcaaaccggtcggcagccgccataaacggccctctccggtattggatatgtccaaccgggaccgttgcccataagtgtgtgccgaaaatggcatccacgccttcgaggcagccatcttcgatcatggcttttgccccgcctggcgcgtattcttcggcatgttgatggatgaaaacatactcgccttccaattcatctttcaattcatgtatcgctttggcgagcatcagcagtgtcgccgtatgcccgtcgtgtccgcatgcgtgcatcacacccggcacctgtgattgatagggcacatcattttcctcctggatcggcagcgcatcaaaatcggctcggagcgcgatggttttccctggctttgcgccttttacacgggcgacgacaccgtttccgccgacatgttcgcgcggccggatgccgaggtttttgtaaaaatcagcgatatagcgggctgtttccacttctttaaaggacaattccgggtgcatatggagatatcttcttgtctccaccatttccgggtacaaaccgtccagttttttatgtattttttccaacactgtcatctgcgattcccccaaccagttatttttactattataccataattgtgaaaaagtctgctgctttatcgcggtaacagcaaaaagaaagcggcacctgcagatgcaggctgccgctgttgacgccttactacatcatttaccgcaccgtgtcaaaacgggccgctgttggcctgtgcgaatggggagatcgcagcttcagccgtcccgtttccggtctgcctggacatggacatgggtcagattagaaacatcgcgacaatggttgtcacaatgagaccggtgatgacagggattacattgcgtcttgccagttcaaacgggtcgacattgcaaatagcggcagctggaattaatgcccacggaatgattgttcccccgccaacgaaaattgcggcaatttgcccgagtgcggtcagggtggcggctcccgaaccaatcgcatgggcaaacagtgctgcaattgagccggcgagtgaaatgccggaaaaccccgatccgtcaagaccggtaatgacgccaactccggctgttgtcagtgcgccgatttcttttgagaccggcataaccgatgccagggcgctgccaagatcattcacaattccttgggaagcgtccggcagatcggcatggatcatcgtatggaaaccgtcgccgccaagatagaaaaacgcggcaatcggaatgacggggccgaacacctggaaaccgaactgcagaccgtctatcaaatattttgttactttttcaaggccgtttttatgggaaccggccattgtaatgagaagcaggatcatgattgaggtgccgccaacgagtgcggttgccgcatccccctgcaaatgaaaaagaaccatggcaacgatgtcaaggatgaaaaaaacaggaatgaaaagagcaaaaagttttttgtataccggcttgagcctggggacttttgcatcaggcggtgcggtgcggccggccgggttctccccggcagcaagcaagccttttttcatatcgcgtttaagcagcagaaaagcggtaacggtcgtcaccacgcccatcacgatgacgagtggcacgcttgcttctattacggacgatacgggaatgccggcaccgtcagctgtcagtttcggcgccccctggatgacatagtcgccggagagggcgatcccgtgcccgaacaagttcattgcgacagctacaccgatcgccggcagcccgacccggagtgcaaccggcaaaagcacagcccccatcagtgcgacagcaggggaaggccaaaagaaagtggagataaacagcattaaaaagccgatgatccaaaaagcgagattcggcccttttatcagctttgcgaacggggccaccatcacatcattgatcccggtatcaagcatgctcctgctcattgagacgataatggaaatgacaagaatgatgggcagcaattctttgatcgcaaatacaaagcttgtaaaaataccgctgacagacgcagtgaacgatcccgttgcaatccatgcaatgatgaaaatgccggcaatacatacaagggacgtatcctttttcagtaccatcatcaggataatgaaaaaaataaacatcaaatatacaaagtgaatggcagtcagatcaatgcccatttccattgcccccttcttgatgcagcatatggcgggggcaataaatgggtgactgtcacgatcagagtgcttatggcaatattatctgcgtaaatccgaatggtaacaataacagatcccggctgcctaagcaggcggccgggatctgtttatccttcctcttcatcttgcgggatgacatattcttttgtaaaagcaggggcatcgtatgtgcttttgtttgtgccgatttcatccagatccaggctatggataagcaaatagtcaatggaacgcttccatctttcgaaactttctttgtctttccagccggtaatggcgatatacgtatccccttttaccgggcggaggagccggtatgctgcaaaaccgggcttattctctatggccggggtgttttttttgaagtggaattcgtaaaccggttttccttcatccggaatcggaagatgggtaaaaatgaagaatatgccgtcttccaaattcccgttggaggcagctagctgataacggcgtggcgaggcaaaaacggttttcccctccgtttcgtgcagcaacagggcatgttccgggttttgcaacagcaccatcttttcatcgggatatttttcctttatttttaagagaaaatcataagtacccgttgtgacgtagacattcatttctatcacccctctctacttccagtttaacctatatctttccgctgttcaatttgtaaagttttgcaaaataaagacggcggccgaaagcgaatagaaataggaagcggctcacgccttttcatcttttctgtctgtgccggagaggcgatgggggaaggaagcggcacaaaatggaataataatgaaaaaaccgggtaaaaatcggacatagcctgtatttcgcgtacaaccctaaggaaaagcaaaatacggcaaatttgtgacagttgaaagagctggctgcacaatgctttttaaaacgattatagtaaaaaaagatattaccctttcaggataaaatagtttttatttgaaaagaattattataaaataaatggtgactgtgtggcgtgaggaggataacatttgaagaaaaaaatcctaaacgattcccttttaaaagcggccaggggagaacagacaggccgcgtccccgtctggtatatgcggcaggccggcagatcccagcctgaataccggaaactgaaagaaaaatattctctgttcgacatcacgcatcagccggaactgtgcgcatatgtgacaaggctgccggtagagcattacgatgtggatgccgccattctttataaagatatcatgacgccgctccccgccctcggtgtggaagttgaaatcctcaaaggagcaggccctgtcatacataactcgatttcttcgttaaaagatgtggaaaaattgggggagttgcatccggaagaagatgttccctatgtgctggagacgatccggctgttaacggaggaacaattggcggttccgttgatcggattttccggcgcgccttttactctggccagttatatgattgaaggcgggccttcaaaagattatagaaaaacaaaagcgtttatgtatacagaaccaaaagcgtggtttgcgctgatggaaaaactggcggacatgatcatcgtgtatgtaaaagcacaaatcaaagccggtgccagcgccattcaaatattcgattcatgggtgggcgctttaaatgcagcggattaccgcaattatataaaacctgtaatggaacggatatttaccgcattgcgaacagaaaatgccccgttcatcctgttcggtgtcggggccgggcatctggcgctagaatggaacagcctgccaattgatgtggttggcctcgactggcggctgccaatccaaaaagcgcgcgcgctcggcgtgacaaaagcaatccaggggaatcttgaccccgccgtgctcttgtccccgtgggaagttattcaagaaaaggcggccgccatactggacgaaggcatggcgcagccgggttacatctttaacctcgggcacggcgtcacccctgatgtccgtccggaaacattaaaaaggctgacaacgtttattcatgaatacagcgaaagaaaacaacaggaggaagcataatggaaaagaaaaaaatcggactgcttgtcatggcgtacggcacgccgtataaagaagaagatattgagcgttactatacccatatccggcacgggagaaggccccaggatgagatgctggaagatttgaaacgccggtataaagcaatcggaggtctgtccccgcttgccaaaataacagaaaaccagacatatgcgcttgaagcgaggctgaatgaacggacggacggagcggaatttaaagcttatatcggcttaaaacatattgaaccttttattgaagatgccgtcaaacaaatgcatgatgacggtattgaagaagcggtatcgatcgtgcttgcgccacattactcggcttttagcgtgaaatcgtacaacgaaagggcgaaagaagcagcggcaaaactgggtgggcccgccatccaatcggtcgaaagctggtatgatgaaccgaaatttgtcgatttttgggcacagcaacttcagaaaacgtatgctacaatgagtgaagaagaacgtgcgtcttcctgcctgattgtatcggcccacagcctcccggaaaaaattttgcagtacggcgacccgtatccggaacaaatccgggaaacagctgatctgattgcggaggcagcgggcgtccaggcgtatgcagtcggctggcaaagtgcaggcaatacgccggatccgtggctcggccccgatgtgcaggaccttacaagaacgctgtatgaaaaacatcattataaggctttcatttatgctccggtcgggttcgttgcggaacatctggaagttttatatgataatgattatgagtgcaaggcagtttgcgatgcagtcggcgcatcgtattatcgcccggaaatgccgaatgacaacccggcttttattgatgcgctggctgaggccgttttgaaaaaaacaaaattcggtttactgccgcaagaataggcagccgccggagatttttaacgtatttccataaaacatgacattattgccaaagaaggtgctgaccatggccggaaacagaaaaaaagtagctgtacttggcggcggaatcaccggcttgacagctgcttattatttgcggcgccttgttgaggaccaacagctgccgcttgatgtgatattgttggaaaaagggcgccggcttggcggcaaaatccagacggtcaggcgtgccggatttgtcattgaacgcgggccggattcttttctggcaagaaagcaaagcgctttgcatctggcagaagatctcgggctttcgccttccctcgtatctaatgcgacaggcaaatcttatattttattaaaccaacagctctatccggtgccaagagggtctgtgatgggcattccgacaagattagcgcctttttttgcttctcctttgttttccgttaccggcaaaatccgggcgctctgcgatttgatcctgccccggaaaaataccggtgaagaccagtcagtcggggattttgtccgctaccggctcggtgaagaagtgctggaaaaccttgttgaaccattattgttcggggtatatgccggggatgtcgacgagctgagcgtgctggcaacgcagcctcaatttttcgaggctgtccaaaagcaccgcagcctgatcctcggcatgaaaaaagtagcagcggaatttgcgcaagactccaggcctacccggaaaaagggggcttttttaacctttcaaaacggccttgaaacgctcgttgaagcacttgaggaaaaaatcggcgctgaggcagtcatgaagggtgtgacggtggacgcgattgaaaaaagcgcgggcggcggggattacaggatcacattgacaaatggaacccacatgaaagcggattatattatttcagccctcccccatttttcgctcccccatattttttcaaagtatgctttttttgcgccgctcgaaaaggtgccatccacgtccgtcgcaaccgtatcgatggcgtttccggagagcgcggtaaaaaaagacattgacgggacaggctttgtggtgacgagaaacagtgattatacaattacagcctgcacgtggacgcataaaaaatggccgcacaccgcaccggaaggaaaagcgttgctgcgttgttatatcggccggtcggcggaagccgcggtcgtcgatctcgcagatgacaggatccagaaaatcgtgctggaagatttgaataaaatcatggaaattacagcagaaccggagtttacggttgtttcccgctggaaatatgcaatgccgcaatatacggtaggccataaagaaagaatggataagattttagcggcagccaaacatgaattgccgggcatttcttttgccggcagctcgtttaacggggtcggcgtgccggactgcatctcccagggaagggcggcggttggcgagatgctccggtacttccaactcaaggctgaattttaatagacagtgaagaagcggtagggtgcattcgactggcacctgccgtttttattgtcccgaaacgggagtcaggcatgtataaatttttccggcgcgttgccaggtaagtatgccgcatcagcgcgcactccccaatggagaaatgctttatttgaagaagcgggcaagctgaaaaatgaaaagcttgaatgattcgttttggcaagaagcagattcactgaatgcaattacttgatgttcaaggggaaacgtggtatattactttttgtgcaaaaatgaccaaaaaaccaaaatagtcaattgttctcgagggaggtggaaagcttggaaacggaccgcaggctgcaaatattaaacgctgctacaaaatcttttgcccagtatggttataaagcgacaacaatggatctgatcgcgaaaatggccaatgttggaaaagggaccatttataactttttccgcaataaagaagaattattccatgaaatcattgcccgcctgattgatgaaatggagcaggtggcagaagcgtcaatggatccagatgcttccttttatgccaatctgcattccgctctgttcagcatccttgaattccgcaaaacccatcagctgacgcttaaattatttgaagagcagaaagaaatgggaacgccggccgtcaatgacatggtcgagaaaattgaagagcggatcattgactatttgaaggggatgctcgaacgggcgatacaggcggggaaaatcaaaccgtgcaatccggaactgaccgcttttatcatgtttaaactgtacgtcgccattatttttgactgggaaaagcaccatgattccctgtcgaaagaggaaatcgcggaggcgtttgaactgtatttgttaaaagggctgcagaactgatttttcggttggaaaaggaggtattttagatggacaatttatggttcgcggaaatacggaatattttacgttcgccgaaaaagctgattgaaacggcagccattattcttgtgccaattttatatgccggcatgtttatctggtctttttgggatccgtacgggcatcttgaaaaattgccggttgccgttgtaaatgaagacaaaggagcacaaatggagggggaacatctcgccctcggggataagctcatcaaaaatttaaaggaaaaggacagttttgattttcactttgtcgataagcaaacagcggagaaaaaactgaacgataaccaatattatatgattatagagatccctgaagatttctctaaaaacgcaaccacattactggataaaaacccaaaaaaattgcagttgaactatattcaaaaccaagcaatgaactacacttcttccaaaattgaagaatctgcaatgacaaaaataaaatcgagcgttgcagaacaggtgacaaaaacgtatgcggaagaagtattcggcaaagtgaaagagatggcaaacggctaccggtctgccggaaacggggcaagtagccttgccaaagggagcggaaaactaaacgacggcgcagttgtcttaagaaaaggaacggaaaatttattgaccggcgctacagccttgaacgacggcatcggccgggttcataacggcgcggctgatttaaacaagggcgctttgaaactgtataacggttcacgcacgctcggcgaaggaattgcccaggcgaacagcggcgccgtttccttgaaaaaccatttagcccaattggcggcaagctcggttactttttcaaacgggctgtcggaggcaaaatcgggtgctgacaaggtcgcaaatggttcaaaatcgttggcctcaggcatgaaccagctgcagacggcaagtggccagttgcttgatgcgtcgaaacagcttcaatctggtgccgacaaggtggcaaacgggagcgccacattaagtaatggcttaaatgatgcaaacaaaaagcttccggcgttaacgagcggcaccgccaaagtgcaaagcggcgtaaaagagctgcaacaaaagttgcctgaaaatcttgcagcgggcattacaagccagatggagaaaacgatgatgtcccctcgtgttcagtcacaaatcgatgcgatgagcggtagcatgtttgaccagcaaaaggcacaggcagaaaacttgctcagccagttaaaacaagtgctgccacccgaaacgtatcagacggtttccaaccaaatcttaagtaattatacagataaaaagaaacaggaattccaacaagcattccaagacgaggtcaaaaataagcttttggcatcgttaaccagcgggtctgcctctacgcaagccgctttgcaaagccaaattcaacaggcgattgctccgtacttttccgacctgaacgaagggcttacaaaggtaagcagcgggcagcaaaaattgcaaactggtattgaccaacttaccaaaggtgccaatactttgaatgctggcgcacagcaacttgcaagcggccaaaatgcattcgtcaaaaacgcaaccatttttaacgggaaactgcaacaagctgcatctggcgcaaacagccttgaatccggggcgacggcggttgcatccggacttggccagctttctagcggatcaggtcagctcgtaaccggaacgaaacaactggcagacgggtcaagcacgcttgcagaagggaccggaaaactggctgacggttcaaacgaattgacgaacggtacacaatcgcttgcaaacggctcaagcgtgctcgtaaaaggcacatcccaattgttaaacggcgcaggccagttgcaaagcggcagcaagcagttgaacaacggtgcgggcaaccttgtttccggcacaggccaattaaatgacggcgcagacaaactgagcaataaacttggcaaagcggctgaccaggctggggctatcaacccgaccggcgccacttataacatgatgagcagcccggtccggctgaaccatgatgctgtgacaaaagtgccgaactatggtaccggccttgctccgtatttcttatcgctcgggctttttgtcggcggattattgctgacgattatctacaatgtaaaagcaccggcaatcatgccgaaaaacggggtaacctggtttcttggaaaattcggcgtcatggcactgattggcgtcttacaatcgcttttggcagatttcattctgcttgatctgctgaaattgcatgtgcaaagtgtgccgctgtttatgatcgcaaccattgtgacgagcctgacctatatggcgatcattcactttttggttgcggcattcgccaacccaggcagatacatttccgtcatcattttgattttgcaactgacgacaagcgcaggcacattcccgcttgaattgattccaaagccgcttcaggctgttcatgatctgatgccgatgacctattcgctgcaaatgttcaaagcggtgatttcaagcggcgatttcagctacatgtggcaaaatgttgataagctttcggtcttttttgcagcgtttatctttctttcccttctgtactttgttgtgaaatttagacatcttcacaggatggcagaaaaggaaggagcagcctctccggtagaagcataagagatttgctgtaaaagcagcaggacgaagccattttggccgatcctgctgcttttttattgcaaaatatgacgaacaggataaattgcttcaggcaacacgtaaaggaggaatggttagtccgactatagttgtatttgtaaatggagctgcatgccggtattttatatttcaagggcttgccggacattgctgtaaaagacaggtttccgccattttccatgtgaagcgatcacaaaagcagcccctttttcggaaacaatgataaaactttcacaaacttgtcatgaacgggtataaaagcgctttctgcaggggcttataataagattagagatggtgtaaaggaaagggtgagagaggtgggctacgaacgattggccagtaaactggtgcagctttcgggaggcggggaaaatattcaagcggttttccactgttcaacaaggctccgctttaaattaaaagacccggggcgggcaaaaaaagcggcggtagaggagcttgacggggtgatttcggccgctgtttccggcgggtattttcatattgtgacagggataaatgccggggaagtgcacaatgacatgttaaaatatctgcatctagtccggatggaaagcgggcaacgggaagaaacttctggctttgaaaacccggtcatgcagccgggcagattaaccggacgcccggatgcggcagaaatatccggccttgaggatcaattgtttcatcagatgatggacacggcgacatccattttgaatgcccggggcggaggcgagccggttatggtcgttttattcgggtgcaaaaacaaagaaccggccgttgccggaggtatcccgcataagaaaacggaagaaccggtgcgatatcagaaaaaggaaatgatcgccagcccgtttacaggggaaacgatcccgcttgagcaagtcaatgatcctgcattttcttccggcatactcggcaaaggggtcggcattaagccttctgttggcaagctttttgcgccgatcagcgggacggtaacggcggtgtttccgagcgggcacgcgatcggcatcacgtccaaaaccggcattcaaattttgattcatatcggtattgatacggtccggctcgaaggaaaatattatcatgtccatgtgaaaaaaggccagccggttgaaaaaggtgaaatgttaatcgaatttgatattcctgaaatcgaagcagccgggtacgatttaacttccccggttgtgatcacgaacgcggacaattatgttgaggtgctggaaacggaccggaaaaaagttgttgccagtgaccagctgatgacgatagtcagttaaaaaacaaacagggtgccacatacggcgccctgtttgtcagtaaacaatatccacctgatgatctttgaaaaaacggagccattcatcactcggtttttcatctgtgaccacaaagtcaacagccgaaaaatccgcaaaatggacaaaggcaattttgtcgaatttgcttttgtccgcgagcagaatgactttatttgcctgtttgagcatttcctttttaatatggctttccgcttcattcgagtcggtgatcccccgcaccatggaaatgcctttacaactgaacagcgccacatcgacattgtattggcgcacagcatgttcagcaacagaaccgaccagcgaattggaacgtttccgcagcgctccgcctgttgacagaagctgaatgtttgactgggccagttcgcttaatgcgatggcagaattggttaagacgacaagtccctctttcgttctgttcaactcttttaacgcttccaacacggtcgagctcgcatccgccacaatcgtatttccgtctgaaatgagcggctgcagcttgccggcaatgttttgctttgcttccatattgacggtgaatcttgtctggtaggggagatcttcatttgtatggagattgagcacagcacccccgtatgtccgcgtcacaattccttctttttcaagcttctccagatctcgcctgatcgtctcttccgttacttgaaactcctttgccaaattggcaacatacacttttttctcccggtacagcgtatttaaaattttatctctccgttcaaaagccagcatgtccccaaccccgttcctgtcctgtatccttttctctgataagcccattttagcaaaaatcgtccgtttaaaaaagaaaacaacaaaagtacaataaaataaataaaaaaatctttttttatattgatttatgtttgttctttcgctagtataggaaatgtgaagaagggttttcacaaaccagttaaagaaagcggtttctgaaccaaattttgaagtgcacgcatggcggcttgtttgtcccgctgcccaacaatcaatataacatggaaggaataagggcggcggaaaaagccatacagattgcttttgatggtttgtatatcggactgctggcggatttttcatctggtaataagatagaagattttaaaataaaggaaagcgaggggtaaaacgtgatcagaaaagcgagtgtaatgtttgtgcataaggatcaatatgaggaatacaagcgccggcatgaccatatctggccggaaatgtcaaaagaattaaaggcgcacggggcccgtaattattcgatttttttggatgaagaaacgggtcggttatttgcttatttggaagtggaagatgaagcgctctatgaaaaaatggcagatacagagatttgcagaaaatggtgggactatatggaaccgctaatggaaaccaatcccgataacagccctgtgtctgttgcattaaaggaagtttttcacctgacctaacagccatcccattcagaactccagcagttcacattgtaagcgatatcaaacccttcataaaaatgataacagaaaggcggagaagaaatggcgagaataggaagcaaaagcacgaccggctggaaagcgacaatttcggttgccatggccaattacattgaagccggttccattatcgcagcagccagcagtttgacgctctggcaggcttacctgcacttaaacagcatttccgtgggtttgttaagcgccctcagtgccaacgcatttggcgcggcaatcggagcactgttcggcgggtatttaaccgataaatacggcagaaaatttatctacacgtatgatttgcttgtatatatgcttggtgtgtttttgattgcggtttccgtcaactttccgatgctgttaatcggcaccattattaccggggtagccgtaggaacaggggtgcctgcttcgtggacatatattgcggaagaagccccgcattcaaagcgtgcggcccatgtaggtacggcgcaattggcatggtcaacggggccaatgatcacgtttctgctcgccgttttgcttgcgccgcttggcctgctcggcagccggattattttcctccatctattagtcatcgcattcatcacttggtatatccgccaggggcttgaagaatcagccatctggaaagaagataaagaaaaagaaaaaaccgacgcccagctggggaaaaaatcaagaagctccttgaaagaattatttcgtttaaaagtaaaccgccaggccctctttttactgatcggcatttatctattctggaacttaacggcaggggcaatggggtactttatgccctatatttaccaaaatgttggcggcctgacgaacgaacaggcgaacttgctgcaagctttcctctgggcgttaacggtgctgacaacctatgttgtctttatgaggctgggtgaccgttacagccggcgtttcctctttggtttaggggcggtgatgggcattgccgcatggcttattttgacttttacagggatgaattggttctccctttttgcctttgttattctctggggaagcgctgccggattcggcgcccaggcgttttacggcttgtgggcgagcgaactgtttccgacccggtaccgcgcgggcgcacaagggttcatttatttcctcgtccggttcggaattgccatctggtcttttctgcttccgaccattatggacacgctcagttttaaagtagcgggaattgtaatgatcgtattccttgtcatccattgtatcatcggaatcgcgctcgcaccgtctacacaaggaaaaacgctggaagaaattgaaaaagaacggttcgggaccgttcgggacggggtaaaacgagccgttacaccaacaactgcagcggaacatttgaatcagtaaaccaaaaggcacaagtgcggatcacacttgtgcctaaaagattatctgttttttgcccggctgaccctgagttcgggctgtttgcttccggctggcaacaacgtcatcagtgaacccgcgacgatcaggataatcccgaccgtaacagccggcgtaatcgcttctctcagaaaaatgagggccaaaattggcgccagtgcaggcttaataaagaaaaccatcgaagccattgatgcacttgttacatccatcgcaaggaagtaaaacgcaaacccgagcccggtgacaaaaatgccgatataaatcaggcttggcagcgtatgccatgcaattccgcggaacacgggcacatttgcaaatacgccgaggccaacggaacgcagccagcccgcaacaaatccaattttcgaaatcaatacaagcgcaagaatttcaatgctgccggtaaaaaagctcaaacaggttaaaatgacaccatcacatttaaactgctggctgccttttctgccgacaacactgtaaagcgcaaacgtaaccgccgaaagaagcgcaacaatgatgccaaatggactttggatttcaaacgggttgacgataaacaaaatgccgaccaagctgatgcccaatgcaaccagcgtccgcttcgaaagacgctcttttaaaagaaaatgggcgagcggaataacaaacagcgggttgcaactgaacaaaatcgcaacggtggaagctttcgtataaacaatggccaattggtaaaatgtcatgctaataacaatacataaaaagccggttacaacaaaaaataaaaaactgtcctttgtcatgtgaaaatgatattttttcatatgctgaaacgccaatggcgacaatataaccgcgccaataaaaaagcgaagcaggttcaattggatcggatgaaacgtaccggcaaccatttttatggcaatttccatcgtgctgaaaaatatagcagacaaaacaatgtataaaattccttttttcatgctcattacctcgatctctttcaaaatgtttaaatggttatccggtcatctgatgatcaacaaaaaacggcagcgcaaattcccctatttcagtttttttcatctcttattataatgctcttccattcataaagaaaaggacaactatgtgaacaataggacaaattggtgtctgccgcctgaagaattcgtttccctctcctttcatcttatttttccttcgattttcgcttgtttcctgatggatttgttttgcagaggaacgagaaagcccatgcagcccgcaacccggtttcggacttggtagagaagtccagcgaatatgaacgatcacgaaaacttgtaagaatggcggaactttaagtatctgaaagtgccacctttttgacgatctgttgaatcaatagacaaagaacagcaaaaaacaaacaacatcatagttatataaattatgtttgttttatttgacaccccaacatagccacattaaaataaaagaagaaacaaaaaatttcagattgaaaggctgggagaggatgaaaacggatacaaaaacataccaaatgtatattgacggggaatttacagatgctgcttcaaaagaaacttcccaagttataaacccggcaacagaagaagtgatttccgaagtcccgaaagcaacaatcgaggatgtcagaagggcaatcgatgcggcagaacgtgcccagaaatcatgggaaaaatgtccttcttctgaacgggcaaaatacttaactgcgatagcacaggaaatacgccgcaacgccgatgctttggcgcgcgtcatttcagaagaagtcggaaaaacgctggaactttccacaaccgaagtccattttacagccgattatatcgactacatggccggctgggcgcggcgatacgaaggggaaatcgtgccaagcgaccgcccgaaagaaaacattttcgtctacaaagcccccattggcgtcattgctggcattttgccatggaacttcccgtttttcctcatcgcccgtaaagcagcgccggcgctgattaccggaaatacgattgtgatcaaaccgagcggggaatcgccgaacaatgcgttggaatttgcaaaaatcattgacaaaatcggcctgccgaaaggggttatcaatattgtcacaggcagcggaagcacgctcggggatgaactgtcccgcaacccgaaagttggcatggtcagccttaccggcagttacagtgcaggagcggccgtgatgcgggcagccgcggacaatattacaaaagtttcgcttgaattaggcgggaaagccccgacgattgtgatggacgatgccgatatcgatcttgctgtcaaatcggttgttgaatcgcgtgtgatcaataccgggcaggtttgcaactgcacagaacgcgtatatgttcaagaaagtgtcgcagatgtgtttatcagcaaaatcgtcaaagccatgcaggatgtcaaattcggtgacccgcttgctgaagaagggctggatatggggccgcttgtcagcaaaagcgcactggaaagcgtcgatcaaatggtgaaaagagcggttgaaggcggcgccaaagtgttaaccggcggcaaaccggctggcagggacaaaggctactattatgagccgaccgtgcttgtcaatgtcgataacacaatggaaatcatgcgcgaggaaattttcgggccggttctcccgattgcgacgtttaaaacacttgatgaggcgattgaactggcaaatgactgccaatacggcctgacttctgccattttcacttccaatgtagacacaatgatgcgtgccagcaatgaattgaagtttggcgaaacgtatgtgaaccgtgaaagctttgaagcgatccagggcttccacgccggctggagaaaatcgggcgtcggcggtgcagacggcaaacacggcctcgaagaatacttgcaaacgcatgttgtatatgtacaatacaaataatcaaaagcgccggccggcagccggcgtttttgattatcgcagtttctcaatttctttcatgattttttcagcatcaaagtccgcacttccgtcaaagtcttttataagctcaccgtctttattgacgacataaaaactcgtgccgtggacaacctggtcatttccatccgatttggcgaccgggtttttaaaatttttcatcgcaaacttttcaatttttttctgcgagtagccggtaaggaaatgccacatggaaaaatcgctgtgaaattggttggcaaattgtttcagcttttgcggcgtatccacttcggggtcgatgctgaaagatacaagttccacatctttgtaacccgcttttttaattttctcctgcaattcgctcatatgcatcgtcatcggggggcaaaccgttttgcagctcgtaaaaataaagtcggccacccatactttcccttttaaatcgtccagactgaaagatttcccatcctggtccttaaattgaaagtgttcaaccgggtccccttttggcgcacaggaggaaagcgccggaagcaaaaatacgaacaacacgagaagtgcaatctttctcttcaaatcagcctccccctttacggatgtaagcgttattttgtatgatcattataacatgtattttcagtataaacggtaaaaacagaaaaaggagggtgaagtggtgaaaaagtggattctggcgggcttgttcctgatggccgtatcgctctttgccggatgcggaaaacaggagcaggcggctgtaaaaccggcgaaaatggtaaaagtgcagctcatcgtgcccaaaaccgctaacgccggcacaagcatcccgttaaaggcggttgtcacacaaggaaaagaaaaagtagacgatgcagacgaagtgaagtttgaaatttggaaggaaaattcggataaaaacagctcgatgttggaagcgaagcatgatcagcacggcatttataccgcaaaaacggtcatcaaagaacccggcacatatacggtccaggtgcacgtgacagcgcggaaaatgcatgtcatgcctaaaaccgctttatccgtaaactgaaaaacaaccgggcagcgtgaaggcgttttttatctttgcgctgccctttttgttattcatggcttttcacatgcaggcagttcgggcatgtattgccatagcattccgactgctcatcgatttttttaccgcattctgtgcaatatttgtcaggcaagtttttgaaaaagtctaaaatattttgtaccattttcacgactcctttgttatataactgtttactatattttttaattgtattataacagtttttaaatgtcaatggcgaaacggtgaattttttagaaaaatagagaaaagatcaaagattgcccacgggcatcccttgttctataatgaaaatgaaagggattgctttacattttgcataaaggaggcggcattatgctgtttattgataatcagggtattaccgacccgcgcatcaaccttgccatcgaagagtatgccctgaaaaatctcgatatcaatgaaacttatttacttttttacataaaccagccgtcgattattatcggccgcaaccaaaacaccatcgaagaaatcaatacggattacgtggacaaaaatggtgtcatcgtcgtccgcaggctctccggcggcggcgcggtgtaccatgatctcggcaacatcaatttcagtttcatcacaaaagatgacggcgagtccttcagcaatttccgcaaatttaccgatccggttgtgcaggcattacgcaaactcggtgtaaacgcagaattgagcgggcgcaatgacatccaagttggcgaccggaaaatttcggggaacgcgcagttttccacaaacgggcgcatgttcagccacggcacgttgatgctcaattcagaacttgataaagttgcacaggctttaaaggtcaaaaaagaaaaaatcgaatcaaaagggatcaagtcagtgaggagccgcgtcgccaacatctccgaatttctcgaccatccgatctccatgtcggcattcaggcaattgcttttggaaagcattttcggcggcaaggaaataccggaatatcagctgaccgaaaaggattgggaaaaaatccgccaaatttccaaagagcggtaccagacatgggaatggaactatggcaaatcgccgaaattcaatctccgacattcccggcgttttccggtgggaacggtcgatgtgcgccttgacgtgaacaaagggatcatcgaaaactgtaaaatttacggcgatttcttcggcatcggggaagtaaaggatatagaagaaaagctgaccggctgccgttatgagcgcgccggtattgaaaaagcgttggaaggcgtagatatccggcattattttggcaacataacgaaagaagattttatcagccttatctattaagaacgcgcaaattcccgggttccaatggcaatccgggaatttgtattgaaatattttaattgtttttatataataaatgggtagaatgaatgattgttcactcagaaaggggagggagaaattgaatttaccgtccagtttaaaaaagacggcggaaacgaacgcggacaaaacagcttatatttttatggatcagcttgttacgtacaaggaacttgacacggccgtttcaaagtttgcggacgggctgaaaaaactcgggctcaaaaaaggggatcatatggcccttctgcttggcaattcaccgcaatttattattgccttgtacggggcgatgcgggccggcgtgacgacgataccggtcaacccgatttacacgccggaggaaattcgctacatattggataacggtgatgtgaaagcagtcgtggcgcttgatttatttgtaccatatgtggataagatcgatgccctgctgccgaaagtagagcattacatcatttgtgaaaccgatccggcaaaagtgggaaaatatgcgcacccaaaattgaaatcgttttcacaaatactggcggaaagttcgccgttcgtcgaagaagtgccgctttctgaagaggatacggcggttattttgtatacgtccggaacgaccggaaagccaaaaggagcgatgcttacgcataaaaatttatattcaaatgcgagcgatatcggctcctatttgaaaatgagcgcggatgaccgggtcattacggcgttgccaatgtttcacgttttctgcctgtcggttgccgtgaatgcgccgctcatcagcggggcaacgctgctcatattgccgaagttcagcccgaaagaagtgttccgggtggcaaaacaatacaaagcaacgatatttgccggcgtgccgacgatgtacaattatttgttccaatatgaaggcggggatccgaaagacttcgcaacgctcaggctgtgcatctcgggcggcgcttcgatgccggttgcgcttctgaaaaactttgaaaaaaaattcaatgtgctcatttcggaaggatacggattgtcagaagcctccccggttacctgcttcaatccgcttgaccgcccgcgcaaaccgggatcgatcggcgccaatattgtccatgttgaaaataaagtcgtggatgagctaggaaatgaggtgcctgtcggcgaagtgggcgaactcgttgtacgtggtccgaacgtgatgaaagggtactataaaatgccggaagaaacggcggctgcgatccggaacggctggctgcataccggggacatggcgagaatggatgaagacggttacttttatattgtagaccgcaagaaagatatggtcattgtcggtggttttaatgtgtatccgcgcgaagtagaagaagtgctttacgaccatccggatgtcgtggaggcagctgcagtgggcatccctgaccccaatcaaggggaagtcgtgaaagtatatgtcgtatcgaaaaacaaaaatctgacggaacaggcattgctcgattattgcaaagaacggcttgccaaatacaaagtcccgaaagaaattgaatttctggatgagcttccgaaaaacacaaccggaaaaattttgcgcaggtctttaaaagaacagctgcaaaaacaatcggcccggccataaaaaatcgggatacggaaaagccaaagattagaaaaccgggcgcacggtttcctagaaaaattgcaatatggaagtagggactgctgaaaacgattaaaaaatcggcggtaaatggcaaaaaacgcatgcaaagccaatcagaataaatccgccgcggaacggaaaaccgctcgaaaaagcccgaaagaaacggcgggacaccaccattcatcgtgtcccgccgtttttttattgcatctttcttgataaacaacactttttcagtgcccttctgaacgaaaagccagatttttggcatcttgttagaaaaacagacaaggcgtataataggaaaatataagaatattggatcatcatttcaaagctggggggataaaagttggaagcagcatccatggcggaggaaaaaacaggcagtttcaaacccgggctgcaggcaggcgcaagcattgcgatcggatactttcccattgcgctcacattcggcctgttgtctaaaacaaccggcctgacattgatagagactgtgctgatgagcctgattgtctatgccggcgccagccagtatatgggtttaagtttgatcgctgccggcacaagcccgtttgtcattatcctgaccacctttgtcgtcaacatccgccattttcttatgactgccgccttgaaccaaaaagtggaagaaccaagcaaatggaaacgcggattgtttgcgttcggcattacggatgaaactttctcggtgctcgccatgcggaacggaaaaataccgctcggctacggatttggcgtcacttttatcgcttatgccagctgggtcgtgagctccgggatcgggtatgtaatcggagccaatctgccgcaatttttgcaggcaagcatgacggttgccttatatgcgatgtttattggcctccttgtcccgtctttgaaaaaaagtgtgaaagtccttttccttgccgccctttcagcagcgttcaacagcatttttaccggttacggcgtcatggaggaaggctggtccatcatcgtatccactttgttgtcggcttttttggtcgaaatggcggaaacatacaaacggaaaaagcaggtgaaagaaaaatgaacaccatcctcctcgtgattatcggcatgggcatcgtaacgtttttgccgcggatgctgccgctcgtccttttgcaaaacaaaacgctgccgccatttttggaaggcattttaaaaaatgttccgtacgccattttaggcgccttgatttttccaaaagtgtttttgatccaaaaagatccgctgttcggggtaatcggcgcgggaacggccatcctcctcgcgttcatcggcgcgaatgtcatcattgtcgtgctcggggcgattgcggtgttgagcttttattcttttctgttttaaggcaaagccgtattggctgttctaaatgcctttttccttggctacatatatagaagaggacaaggaaggagtgcatgtggagtgaagatgaagtgggcgctgcgggcgattgcggcatacatcctgttcggccttttgatgtactggtatttgttttattacgccgatgctgctcttcccgcccaatataaagggacagccgcagatcccgctacttttatgagcggccgccaattgtttttaagcgaagcatacgcaaaaatcaggaatctgctttttttcctatccgtgccgtatgaatggctgttttattttttggtacttgtgcttggcatttccaaaatgtttgaacaatgggcagcggcagtttcacgcatccgcctcattcaaaccgcggtttatttcttttggttttcgcttgcatcctttttgtttacctttccgttcggttatttgtcccatcgtttttcaaaagcgtacggcatttccacccaagattttgcaggatggatgaaagatgaactgaccgatttctgggtaaactttgccatcatgtttgctgtcgtcgcggtattgtacgccttgatgaaaaaattccggcgaaaatggtggctcccggcctggctgctttccattccttttacggtattcatgatgtttatccagccggtcgtgattgacccgctgtataacgatttttatccgttaaaagataaggcgctggaggcgaaaattctggcgcttgcggaaaaagcacagattcccgctgatcatgtgtacgaagtgaatatgtcggaaaaaacaaacgccctgaatgcttacgtcaccggcatcggttccaactcaagaatcgtactctgggacacgaccctcaaccgtatggatgataaagaaattttatttgtgatggcacacgagatggggcattatgtagaaaaacatatctacttcggcatcgcgggctatattttgatgatgctcatcgggctgtggctgattgccaggtggatgaatgcggttgggcggtggatgtccgggatttccagcatcagctcgctgcctttatttttgctcatttcctcggttctcctttttgcgtcaagcccgcttaccaactgggcatcgcgctaccaggagatgcgggcggaccgttatgccgtacagatgacgcatgataaaaagtccggggttgaaacgttccaaattttaacaaaagcgggtttaagcgaagtcaatccaccgcttcttgtcaaaatatttcgctatgaccatccaacaatgctggagcggatccgcatgctggaagaataagggatactgaaagtgcagtaggcgcggcctgttccgggcaaaaatcttttggccgcgccctgcatttgccatttttatgcaaaagaaaagccgtgcaaacgggccgggcctgtttgcatggcctgtatttaaccaaattgcaggttgatttttttcagttcgtttgttaaatgcatgaactgctccttatcgcgaagatcaagtacatggtcaatttttcttaacaacgcttctctttttttgttcagcaggatctcattcagcaacatgtccgtgtaaatgtgttccacaaatttctccatctgaatccgggacttcgggctttctttcggcacgtcagagaaagattttttgttttccatgtatgatcacctttttccgcttttttttattatacagagcatttcaataaaaagcaatgtaaaaattgaatttttctgaaacggtaaacaaggaaaaaaatgcatatttttagaaaaacgactagaaatgtaggaaatttgtactataatagaaagtgaattatgagaaaaatagaatgggggaatactttatgcaacatggagaattggacattcatccaaatacgattgcgctgattccttgccaggagggaggagaaacagggacaaaaatactggaagtggatcgggaacgatttgtgccagaacttcccctgagtatcgtgaaaaaaagctgtcaatactttggaagcgattacgaaggaaggaaaaatgcgacaaaaagcttgattcatgttcggcacaagccgccgatcctcgttgatcctcatacagctaccataatttttccaacaaaatcgcccagccagccggactgtatttggctgatctccgggcatattaaagaccacaccccagaaggcaaaaaaactgaagtgattttttcaaacaatcaatcactcgtattgccaatcagctacggttcgtttattaaccagtaccataaagcagctgctttgcaggttgcttatgaaattaatatccgacgctcccgcatgcaatttttgaaacaacagggatacagggcgatggaagacagcgggctgtattggatttaagcttggcagggagggggcccctgccttttcgtccaataaaacgaacgcctgcccgggaaataaaaatgaaacattgcgaacggcaagtccgtatacagggggtagtgcaatttgaggaggtttggaaatgaacaaccacgatattgattttaaactggtcggggatgacatgcagtttgtcgaagtcgagctcgacccgcaggagaccgtcatcgccgaggccggcagcttgatgatgatggaagacggcatccggatggaaacgatttttggcgacggatcgggcagccagggcggaggcattatgggaaaactgttctctgcaggaaaacggctgatcaccggcgaaagtctttttatgaccgcctttacgaacgaaggccgtgataaaaagcatgtagcgtttgcagcgccttatccgggcaaaattgtaccgatggatttaagtgaacaagggggaaaaatcatttgccagaaagatgcatttttggcagcggcaaaaggggtttcagttggtgttgaatttcagcggaaacttggaacagggtttttcggcggggaaggatttattatgcagaagcttgagggagacggccttgcctttattcatgcaggcggcacgatccagaaacgcgagctcgcacccggcgaaacattaaaggtggatacaggctgccttgtcgccatgtcacggacgatcgattatgacattgaatttgtcaaagggatcaaaacagccctgtttgggggagagggcctgttctttgccactttacgcgggccgggatcggtctgggtgcagtccctgccattcagccgcctggccagccgcgtatttgccgcaatgccggcagcgggcggttcgaaggatgaaggcagcatggcaaaaggcttgtttaatttgtttaacggggattaagaggtgtaaaagcactgcattttgcgggacgtttcccggaacaggcagtgcttttttttggcatatgaaaaaatgatacgcccggacggaagcggggagagtgccccgacggcggttgcgtggaccggccggatggggagggcatccggattggatgggaaggacttttccgggggcgggaaaaggcagtattttacttggaagcggggcatcccccggcagaaaaaacaggaagcatatttttttggcaaaaagcttgattcatagaaaaatatccgttacaataaaagaacaaatgttccttgtccggcatgtttccggatatggagccaactgagcccatcaaaaggaagtgaaccaattgtcccttcgatttattaccgggcgccccgggacaggaaagacagctttcatccaccgtgaaatcaggcagaaactgcttggcgatccgggcggggcaccgctcatttaccttgttccggagcaaatgacttttttatcggaaacacggcttgcgcatgaccctgaactgggcgggatgatccgcgcccaggtgtacagttttacgcgccttgcctggaaaatattgcaggaagtcggcgggatcagccgtacccatgtatcgagcagcgggttaaatatgctcattcggaaaattttggaagaccaaaaagaagaactgtcggttttcacgcgggcggcggataagaccggctttattgacaatgtcgaacgcattctgactgaattcaaacgattttgcgtttcacctgcacagcttcaggaaaaacgtgcgtcaatcgaggaagcggacggggaaagagtgctttccgacaagctgcacgatttggaatgcgtatatcaggcatatgaacaaaagctggaaggcaaatacattgattcggaagattacttaaggctgcttgcttctgccattgaaaaatcccgctatctggacgatgcggaaatttatatagacggcttccatacttttaacccgcaggaatacttggtgatcggggaactcctgaaaaaatgtcgccgcgtgacggttgcgctcacaacggaccgggctttccgcgggatgcagccggatgatttatacttgttccggatgccgggagaagcctatgcccatatttatgaactggcgcgcgcctttcaaattgaaacggaagaagacgtggcgctgtatgaaccggtccgtttccggcatgaaagtttgcgctttttgcagtcccggtttgaagaactcccgtttccttcttttccgggggaaagcagcatcgaaatctggcaggcgaacaaccggcgggcagaaatcgaaggcgttgcccgttccatccgtgaagcggttatggaaggcagctgccgctatcgtgacattgccctccttgttcgcaacggggaggcctatcaggatttaatcgaaacggttttttacgattatgatgtgccgtattttattgacagaaaacggccgatgctgaaccatccgctcattgaactgatccgttcgactttggaaatcatccgcggcaactggcgttatgaaccggttttccgtgccatcaaaacagaattgctgtttccgcctggagatacccgtatgctgcgtgaaaaaatggaccggcttgaaaactattgtctggcttacggcatccagggggaacggtggacgagtagaaaaagatgggaataccggcggatccgcggcctcgaactagaaaacctgccacaaacggatgaggaaagaaaaatcgaacaggaactgaatgaactcaggcttctcgtcacggcgccgattttgcgcctgtcgcggcgtttgaagcgcgcccgcactggaaaagcgctttgtgaagcgttgtatctttatctcgaagaattggagattccggaaaaactggaagcgctccggcttgaaaaggaagaagcgggggatcttgtcgctgccagggaacacgaccaggcatgggatgaagtcatgggcgttttggatcagtatgttgaaatccttggcgatgaacctgctgatgttgggaaattctctgccattatggaaaccgggcttgagtcattaaaattttcgatcgttcctccggctttggaccaggtgctcgtggcgaatctggagcagtcccggctgtctgatgtcaaactggcgtttatcattggggtcaatgacggggtcatgccggcgaaaatttccgaagatggcgttttaaatgatgaagagcgtgaatatttaagacttaccgggcttgaaattatgcccggcagcaaaaggcgcctgctcgacgaagaatttatcttttaccgggcattgacgacaccttctgaaaaactggtactatcttttccgcttgccgatgaagaagggaaagcattgctgccgtccccgttcatcaaccggatagaggacatgttcccggcacgcggcggcggattatgggtgaatgacccggcggaactggaagagaagcagcaagctgcatacatttcccatccggcggctgccattgcttttgtcacttcgcagctgcagttgaaaaaaagagggtatccgatggccgacttctggtgggatacgtataacttttatatggagcacccggaatggaaaaatcgggcggcccatgctttttccagtttgttttaccaaaacaaagcccggaagctctccgaaaaaacgagccgggaactgtacggcgaccatatccttgccagcgtatcgagaatggagcagtttttcacctgcccgttttcccatttttcgacatacgggctgaggctgcgggaacgggatgtatttcgtcttgatgcgccgaatatcggagatcttttccacggtgcattgaaatggatttccgacaccctgcagcgccaaggcattccgtggtcagagatcacaaaacagcaaagcatggagctcgcaaaagcggctgtggacgatcttgccccgaaattgcagcatcaaatcctgctcagttcaaaacgctaccaatatattaaaaggaaactggaacaggttgtcggaagggcttcatatattttaagcgtccatgcgaaacggagcggctttgaaccggtcgcgatggaactcgcttttgggccgaaaaaagagctcccaccgctttcgtttacattgaaaaacggggcgaaaatggagctgcagggccggattgaccgcgtcgacaaggcggaaagtgaaaacggtgtgtacgtcaggatcatcgattacaaatcaagtgcgcacaagctcgatttgacaaatgtgtattacggccttgatttgcaaatgctcacctatctggatctcattatgacgtattcgaaacagctgacaggggaagaaacgattccggcaggcgttttgtatttccatcttcatgacccgctgatttcggcggaaaaaatgttgtcggctgaagaaattgaagaagaaattttaaaagacttccggatgcgaggactattgctggacagcccggaagtgatcacattgatggaccggtcgcttgaatccggcaacagtgcgattgtgtcggcaggtttgaaaaaggacggccaattaacggcccggtccgaagtggcaagcaaagaagactttgaagcgatccgcagctatgtgcgcaatatttacacagaggctggtaatgcgatcctgtccggtacgacggatatcgcgccatataaaataaaaaaacaggcggcgtgcacattctgcccgttccgttcggtctgccagtttgaccagtcgatggaagaaaacaattaccgccttattcacccggaaaaaccggaagaaatcctcgccaaaatgagaaaggagcgcagaacagatgaaaacagccattccggataaaccggcgaatgccgtctggacggatgaccaatggaaagccgtcatggcaaaagggcaggacatccttgtcgcagcggctgccggttcaggaaaaacagccgtgctcgtggaaaggattatccaaaaaatattggatgaacacgatccgctcgatattgatgaactgctcattgtcacctttaccaatgctgcggctgcggaaatgcgccatcgcatcggtaaagcgatcgaggaggcgatcagcagccgcccggattcgcatcatttacggaaacagctgagcctgctgaataaagcgccgatttccacgctgcacgctttctgccttgaagtgatccgaaaatattattatttgattgacatcgaccccggattcaggatcgctgatgatacagaagccgaacttctgcgcgatgaagtgctggatgacctctttgaaacggagtatgcgaaagcgggaaatgacctgttttaccgcacagtcgatacattctcaaacgaccgcagtgatgacgagctccagcatctgatccggaagctttacgatttttcccgttcccacccggatccgtctgcatggctcgataaaatggtcgagctgtatgatgccggggatgtggaagaggtggacagcctgccgtttatggcagcggtgaaagctgatattcacctccagctgcaggctgcaaaagacatgctggaggaagcgtatggactcgccttagagccgggcgggcctgcgccgagggcggaaaattatctcaatgacatgaagattacagacagattgcttgcggcaattcacggtccatggcaggggctttatgaagaaatgaatgcatggcagtttacacgcgccaaagcgtgcaaaggggatgcatatgaagcggaactcgtcaaagcagccgatgatttgcggaaatctgcaaagaaaacacttgaagatttaaaaaaagactttttctcaaggaagccggcatcgttcctgaaagacatgcaggaaatgcggccggtgattgcggaacttagaacgctcgtcaaaaaatttgcagaggcttatggcgcggtaaaagcggaaaaagggatcgttgatttttcggacttggagcatttttgcctggacattcttgctgaaaaaaatgaagatggcagcctcaccccgtcagaagtggccaaagcttaccagcagcaatttaaagaagtgctgattgatgaatttcaggatgtcaacatggtacaggaaacgattatgaaccttgtggcaaaaggggcgggatttgacggcaaccggtttatggttggagacgtgaaacaaagcatctaccggttccggcttgctgaaccgaacctgtttttaaaaaagtaccgggattttgatccggaaggccgggatacaggtctcagaatcgacttgtcgaaaaacttccgcagccgcaaagaaattctcgacggtacgaattttatttttaaacaaatcatgggcctaaaggtgggcgagatggcatatgacagccaggctgcacttgtggcaggcgcctcttatccggaaagggatcatccggtcaaagtggcattgattgaccaggccgatgaagcgattgaagaagacatttcggatgaagaaacgctggaccgggccgaactggaacaatcccagcttgaagcccgttaccttgcccgtgaaataaaaaaactgatcgacgaagaacaggtttacaatccgaagaccggcacattccgcccgatccggtacaaagatatcgttatcctgatgcgttccatggcatgggcgccgaccataatggaagaattgaaacaggcgggcatcccgttgtacaccgaactttcaaccgggtattttgacgcgacggaagtatccatcatgctttctttattaaaggtaattgacaacccgtatcaggacattccgcttgcagtcgtgctccgttccccgattgtcgggctcgatgaagaagcgcttgcccttatccgcattcatgaaaagcggggtccgtattatgaagcggtgaaaaaatttatagcagaccggccggatcctgaggaagaagaagcgtatgagaaagtgtccagattcatggaaaaattgtcggtgtggcggtctgttgcaaggcagggggatttgtcctccctcatttggcagctttaccgggacacgcagttttatgactttgccggcggactgcctggaggaaagcagcggcaggccaatttgcgggctttgtatgaccgggcgcggcaatatgaagaaacatctttcagggggctgttccggtttttgcgctttatcgaacgcatgcaggagcgcggggatgacctcggaacagcgagggcattgagcgaacaggaagatgtcgtccgcctgatgaccatccatgcaagcaaagggctcgagttcccggtggtgttcgtggccggtctcaataggaaatttaatatgcgcgatattagccaggcgtttcttcttgataaagatttcgggttcgcctcaaagtatattcatccggaaaaacggatcacatacccgtctttgccgcagcttgcttttaaaagaaagaaaaagctggaaatgctggctgaagaaatgcgcgtcttgtatgtcgcactcactagggcaaaagaaaaactgtatttggtcgggacggtgaaaaatcttggcaagcgcctggaaaaatgggggaaaacgaggcggcaggaaggctggctgatgccagaccatgtgcgcgcagcggccggcacttacttggactggatcattccttcgctcagcaggcatgcggacggaacagtgcttttcggggatgacggccgggtggtgctggatgatccatccaaatggcagatcgccgttttgccgaaagaacagtttgccgatatccaggaaccggaacaagttggggaagtggactggcagcatcaagtgaaagccggcctcccggttgcggcggaatccgcttataaagcacaggttttcgggcgcttaagcttccggtacagcaatgagccggcaacattccggcgtgccaaacaatcggtatctgaattgaaacggatgcatgaagagcatgacgaaacgaatggtacccggtttattccgaatgcggaaaaacatatctttgaccgcccccgttttatgcaggaaaaatcgattacgccggctgaacgcgggacagcgatgcatatggtaatgcagcatatcccgtttgatgcgccgccgacttatgcttccgttgaggcgctggttgaagagatggtgaaacaggagctgctcacggaagaacaggcggatgccattgcggctgaacagcttgtccgcttttttgaaacggatatcggccgccgtatcctagcagccggccgggtgatgcgggaaatgccgttcagtttgtccgttcccgcagcggaaatttaccgagatgcatctcttgcggatgaacatgttcttatccagggcatatttgattgcgtggcagaggaaaaagacggcctcgtattgctcgattttaagacagacaatatccatggcaggtttaaaggcggatttgaagaagcagagcctgtcctacgcaaacgttatgaagtccagctggccctttattcaagggcgctggaaaccattttaaagaaaaaggtaaaagcgcaatacttgtatttctttgatggcgggcatcttctcgaaatccaatcataaatgggccctcctttaagggagcccattcttgccatagctattgcaacacataaaaatttatctttccattttgaaggcagcgaggtagcggaaaatttgcctgccctctttgcctttctaatggtttcctgcagatggctggtcgacaacactgccgttagccgtattgtttacactgagcgcgttgtttgtaatgacaaatgcggaagtggaaagagaaccggagccggtagatgttttcgaacttgttttcggagagatgacagctgtgtcgccaaaatggacaatgccgcttccaacattatagatttgtaaagggcctacaatggccggcattttgatcacctgctttcaggattaatctggcatgacgctgctttcctcgctgacggcaacggtgcgcgggggaacacggccgccaagcttcagaatattcgggtctagctgacgggtatggtggacccttgattcaagggcgattgatttagtgcttccgacttgcatgacggttgaagtcgacatcccaatgatctctacattcgaaacttttatgaccggattttcttggtaaacctgaaaccggatttgttctgttactggcggaatcggaacggccaggcggaaaatgggaaaagtttgaaacggcgcttcaaatccgtagtacaattcctgctggcgctggatcgcaaggacggcggcagacatctggatccgctcggagtctccaacaatgacgttcgaaccaaatatgacggttttgacccggagcgtatccacaaaggagtttctttgcatcctgctatcccctcggcacaaacggcacgtacggactgataattagggattccggcggcgtatcgaaggccgctccctgctgaatcgtttccgtatcgccaatgaggaaaaccgaggcacttgaaatcccgataatttggacataatccacacagatttcacggtttgtgacgttcagttccatcgctggcacctccgttcatttgcggcggcagatgggaaataaaaacttgtacggcatgcgccatatccgccttgatttgcccgagcaatttgtcaaaccattcgccttcaacgggtccggttgaattgagctggttgatataataatcaatgcgctgtggaagttggtttttcaagtcattttttataaaattatgatattcttgatttaggcggactttaaattgccgctcattgtcggtgatcgttgttgggagttctttttccaaatattccatcagtttttcggtaagcgcctgttttaaagcagcacggtgttcattattggcatgggggatgccctgcgtttttgggatggctgcatcctctatgctggacaggtcagacggattaatgccgatattcaaggtgccatccagtgtttcaatttttagctgatcaaatgcatattcgatccggtctacccggacaggcggccttgctttcagctgctcaatctcctctatgagggaggcaagcgtcttttccattttcgccaacttcgtttcatggtgttgaaagtattggtaaagctgccggagttcggcaaaaaggtctggcattcaaaaacccccttctggcttaaagcccggcagtgaccgccggcttggatcggaacgaaacaatcagccttgaacttaaagcaaaaatcggcgtgcagtgtcaatgctgaacctggcgcaggctccggaaagacgtgcaggttccgtacacgtgtacataccagaagtcgctgccgtctaaatgtgtcaagaaagaacatgccggtttcagcacacgcgatctaccctacatctgtccggaaagaacatgccggcttcaaacacgacgccgggaaaaccgggtccgcgcatcctgcagccaggaatgtatcaaggccgcggcttttagaatgacgcccgaaacaaagtggtgcttcaagcccgaaatggcgcataagccggaaagaacatgccggtcatgttcaggcataacgccgggaaaaccgagcctgcgctttctatcttgagcttgaagcggaagcgccggactgcatcggaacggtcacattcggattgtaaggctggtctgcagcggcagtaggagccggttcggaaaaatttccggtattatacaaataagctgccggcttgatgatgccggacgtgccaatttggaagacggaagaattggtaatgccgccgatcttgatcatgcggatgtggatgctttgttgcacgtaaaaattcatctgttttcacccgttacaaattaaaatagtttccctggtcaatggcatcaaaatcatacgtgttggtattggactggtagtttgtaatggacaggttttcaccggtattaaaagatcccgccccggcaaacgttttggaactggcaaccggctgaattaggaatacgtcaccgacattaaagacgccgcttgatccgatgctgataatttggacggcgccgacaaaaccgggcatggcgcgcacatccttccttggtcagtggcaattggctttttcatattttattgtatgaagcaaccgaaaaaagggtgatttatccgcctaacaggcaaaaacaaaaaaggagcgttgcaatggctgaatgggcgccaatccgtgaaaaacggcggaatcctgcaattgacatactgaggggattttccctttttggcattctgatggtcaatatgctttcttttctgtccccttatctttatataaatccgtatgactggttcaaagcggaggatcgggcaatcgtgacatggattgaggtatttttccagtccagtttttatcccatttttgcgtttcttttcggatatgggctgatggtgcaaaaacagcgggcggaaagggcaggggtcgaggtttatcagtttcttttccggcgcctttccgttttgctcgttctcggccttgcccatgcatggctcatctggccgggggacattttagcggcttatgcagtctttggcatgatgcttttgccttttctgaaactgggaggaaaagttttgatgtttggcggggctgcgctcttttttatcccgcatttactcataagcttttacctgatggtgatggccatccggtcgccggacgcttcacttttgtataccgactggcgcaatgccaccgcttcattgcaggtgtatgcaaacgggagctttatcgacattacgaaaagaaggtggctggattggtatgcggtatacggcccttccggcacatggcatgcttttctgtctgtttttccgctgataatggcgggagcgggcgtttgcagggaaggctggcttacaaagaggaggattccggcaaaaaaatggctgctgtttttttgttgctgctttgcttttggcctgttttgcaaactgttgccggttattgtcgcccccatcctgccttttctgtacatccgggagacgatcggcggcgtcatcttaagcggtgcttatgttgcactcattgagctctgtgtgaagcaccggctggcggattttctcaggccggttgcaatggccgggaggatgtcgctttccaattacatcagccagtctggtttagcctctttgatcttttacgcctacggtctcgggctttacggaaagctgtctgtgtcaagcggggtattgcttgttgttttgctttttcttatgcaagtgctggtttccgacatttggctgcaccgcttccgctacgggccgcttgaatggggctggcggcgactcagttatcgaaatgacaaaaaaggatgaggtgtatacgatgaaattcatgagctttgtttggcaagaccaggtacaatacggtgtgctttataatgaaacaacgattttaaatttacgggtcttggatggttttccgccatctttgcttgaaggcatccgggcgggcgaggcgtttaccggccgtgtccgggaagcattgaaaaaaccggaagcaacccttgatggcgcgctcgttccgcttcacgaggtttcctgccttcccccgattccgaatccggtgagaaacatgttgtgtgtcggcaaaaattaccgggaacatgcgattgaaatggggagcgcggaagatattcctgaacatattattgtgtttacaaaagcgacaacaactgtcaatgcacatgaagcaccggttgattcacaccggacggttacccgcgagttggattacgaaggggagttggccgtcgtgatcgggaaggaagggaagcagattgcaaaagaaaatgccctttcccatgtgttcgggtataccattttaaacgatatcacagcgagggatcttcaacggaagcataagcaatattttatcgggaaaagtctggacggatcctgcccggttggtccgtggattgtcgatcattccgaaatcgaaaatccgaatgcgcttgatatcgtgacaaaagtaaacggggaagtccgccaacagtccaatacatcccgcttcattttcccggttgaggagattatatccgaattgtcgaaagggatgacgcttttacccggggatatcattgcaacgggcaccccagccggcgtcggcaacgggtttcatccgccgcgtttcttgaatccgggtgatgaggttgaaattacggttgaaaaggtgggaactttgcgaaacaccatcaaataaagtaagatgggtataagacagataaagaagcaaaggagaagatcgaacgatgttaacccggacagatgcgcatgtcacaacatgggtcattgcgatccttttgtttattttggccttgttcctccatcgcgcaggaaaagaaaaggcatttaaaacggtccagatggttttaaggctgttttacatactcgtcatcgtcacaggtgcgctgctctttttccataaccagcgcctcgatcctgccctgtacggccttaaactgcttggcgggattctcgtgatcgggatgatggaaatgattacgctgcggctttctaaaagaaaaagtaccggaattctctgggttttgctgatcatctttttcgccgccgtcctgtatcttgggctgcgcctgccgatgggatggcatcctttttattgacgcccatgcggtaccggtgcaatttttcaggataggatttggagaggggaggcaagggtcggcttgcctccctttttacatttttttcaaaagcatgcgccttccgttactccatgtacactcgaaccactcgtccgcttgtttgcccagccggaaatggtggtggacggataaaatagcctccccgttatcaaacagcatgaaattcacgccttcttttttctccaggttgacgaggcatgacaatacgttatgacagtagatacaatcataaatagaaaagcctgccccgtttaagaaagagacgaagcggtgaaacaggccgtcctcccactctccgaagagcatctcaagcgaaaaattgaccggcttcggaatccgcaagcttgctttttcttcaagaagaagcatttctccgtccgacatgacggtttgatcttctgttaatatgccttttttccaacgcccggaatggaagatttcaattttttggccaacaaactcctcaagcatcgatgcctcatcagatatatcatcaaaaaacacccattcttcattcagcttctcgattgaaccggttaaaaaagcgcgggactggcattccatgatttttaatctgaactgtccgtccatttgcggccctccttcccgagcatcatttccttatttgtttttgacaaggggaggggttttcatacctttataagcagaaagaaaagggtccggagctagagattttagcccgtaaaaatgttcactgttttgcatcaagaaactttggtccggggaaatgtacgccggtatcgtgcgcgccttttttaagcaaaaagaaaaccggaaaggaatgtgcctttccggtgtgcgcgtcagccgttgatcacggtgccgccgtttacgtgaatgacttgcccggtcacatagcttgagtcgtcggacgcaagatagacataggcaggtgccagttcggacggttgaccggggcgtttcatcgggacgtcggaaccgaatttttcaacctgatctgccgtaaaggttgacgggattagcggcgtccagatcggccccggggccacgccgttcacgcggatgccttttgatacgagcgcctgtgacaaagagcgtatgaatgctgcgatggcgccctttgttgccgaataatcaagcagttgcgggctgccttgataagccgtaatcgaagtcgtgttaataatggagctgccttcttttaagtgcggcagtgcggctttcaccatgaaaaattgtgaaaaaatattggtccggaatgttctcacaagctgttcttccgagatatccagaatgcttttttgcgggtgttgttcggccgcattattcaccaaaatatcgagccggccgaatgtgctgaccactttttccactgcgtcccggcaatgctgttcgtccccgatatcgcccgggatgatcaggcattggcgcccctctttttccaccagttcttttgtttgttttgcatcctcattttcattcagatagcaaatggcgacatgcgcgccctcttttgcaaaataaatggcgacagattttccgatcccggaatccccaccggtaatgagcgcaatttttccatctagtttgccgcttcctttgtagttgtcttttacatttttcggctgcgggttcatttccgtttcagtgccgggctgcctgttctggtgctgggcgggtaaagttttcttggaagcattttgttcgttcgccatttttaccactcctcgttcaatttttaaacggaacggcaatccggaatttggattgaccggccatcaccattagtctatacccgtccaaaatttctattaaccggtatacccggaaaaaagttggaaggcgttatggcagctcattcaggaaaaagacggatattgtgccaggcccggcgtgcgacccgatcacggcgccgattgtgttgatcaagaattgttttgtaccgaaacgtgcttcaatcagctgtttcatttcttctgcagccgtttcatcatcgccgtggcagatgccgatcagctggtgttcaaggtctgtgccgcgttcttccatgatatcgagcatacggtgcaacagttttttccgcccgcggattttttcaatcggaatcagcttcccgtcctctacatcgaggatcggtttaatattcagcaagccgccgaaaaatgcgcttgttttcgatagcctgccgcctctggcaagaaaatcaagatcggggactgtgaaaatatgctccatatgtttgctgcggaatgcggcatcccggatgatttcctcttttcctgccccgtttttccgtaaatcggcggctgcttttacaacgaggccgtaaccgatcgaagcacattttgtatcgagtaccgttaaatcaagattgggataggcttctttcacttggtcggcgatcatggccgccgtttggtacgtgccggacagctcggacgaaaaagccaggtaaataccggtatctcctgatttggcaagatcggtaaaaagtttttcaaaatattgcggtgacggttgcgacgtttttgtacccacccccgcgcgaatcaagcggaacacttctttcgggtcaatgccgacaaggtcgtcataggatttgtcctctacatacacggtcaacggaatcaagtgtacatggttttctttgaaaaaagacagcggcaagtcgctggcactgtcagcaaaaatttgaatgcccatcgttttcaccctcacaatcagttctgtctttagtttaccgattttccccgttttgcacaatttcaagcagatgcttcaagtgaggaaaaatgaatcttggggcgctgccgaaaagaaaacccgtttcaggaagacgataagcaaaaccgatgcagaagacaacaagcgaaaccacatggcaaagacagcaagcaaaaccgctgcagaaggcaacaagcgaaactacatgccaaagacaacaagcaaaaccacataaacaaaaggaatagctgccggaagtcggcagctattccaattttccaagttcatgctgcatgtcgcgcagctgtgctttttctgcaagtgtcgtgttggcatatgcactggataaggcgtttttcgctttttgcaccatttcgtttttttcttgttccgttccgaaagcagccgtctctttcgccagttcgacaaattgcctggcctcttgaaacagtcggttcgccattataagatgcctcccgaattgccttcttcgctcctgttcgcttctgcttcggccaatgtggagtgatacgggaaacgctcgctatactttttcactgcatcttttccctgatggacaaaacgtttcgatttgctgcttctgcccaaacgaaacaccgcctttacgggaagggtgcacggggtgccgcgcccatttatagtgttggaattcccggcgctgattatgcgtttttcaggagatggctttcaaattcagcgcttcttcaagaaaaaggccaatgccgtcttccgtattggaaagggtgatttcatttgcgattgcttttaaggccggaatggcatttcccatcgcaacccccgtccccgcgtattcaatcatttccaggtcgttgtcttcatccccgaaggcaatgatccgttctttcggtattccgtaggcgtcggcgacttttttcacgccggccgctttattcagcccggctttaatgatctcgatgatgtgccacggtgccccccagcgcctgtggtcgatcacttcggcatggacatcgcttaagtagctgcggatcaacggcacgtcttcctttgctgcatggatcagcatggacgtcggctcgtcttttaaaaagcgcattaaatttccggttgtgacatgcgggtttccaatttgaaaaatattgagcagtttttcgtcgtgataatggaggtacacctcatctttcacttctgctacaatattatacagccggaaatcgccgcatgtttcaacgatcgattttgctacttgaagcggcatcggttcatgatagatgccaaagcccgtatttttcggatggtggacaaaagcgccgttaaaattgacaatcggcgtatcgagtccaagttcttcataatacggctggctggagcggaaagggcggccggtagagatgatgaccttatggccggctttgattgttttttgcagaacggattttgttttcggggagatggtcttttcatcatttaacaatgtgccgtcaagatccaatgcaattaaataaggttgaggcatttgaatttctcctttttctcgaaatgattcagtttacatgcaattttcgtgatgatccattatactaaataatataacattttcccagcttaaaaacctgctgtaaagcatttttatcttgcataccgttttgttatgatagttacggaggaggtttgaaaaccatggatgaagcattgaaagaaaacattatgggcgcgcttgaacaagtgattgacccggaaattggcatagatattgtaaacctcgggcttgtgtatgatctcgacctagatgaggaaggctgcctgacggtgaccatgaccctgaccgcaatgggctgcccgctcgcgggaattctcgttgaccaggtgcaaatggcggtacaggacattcctgaagtgaaggacacccatgtcaatatcgtctggaacccgccgtggacaaaagaccgcatgtcgcgttatgccaaaattgcgctcggaattaactgattaaacagccccctcttcgccgttgtattttttggctggcaaaaataagcgctcatgctttaacaagatcagcccaaactaatgctgacgataaaaaaagggggcgttactttggggcaaagcaacctgtttcaccccggaagcaaagcaccgaataatggggtttatgtagaagttggcgaaaatggcgacccggtcgtaaacccgaaaagcgcccatctccacagaggcgaccgctttccggaaacaacgaacgatgcccgccattggaggcgcaaacgcaaaccttaaaatcaaaacggggagaaatccccgtttttttgctgccgtcaaaggaaaaacggtaaaataaggacaggtgcccgcgccgcgttaaacggtacgcgccattcggaggtggaatggatggatatcaaccgcatgacttttacggtacaggaagggttggcggaagcccagcagctggccgctcaaaaacatcacccggaactcgatattgcccatttatggaaaacgttaatggaaaagccggacagcctgcttcctgagatatataacggccttggcttaagcaaggaagaaattggaaaaattgcagatgggattctcgcgaaaaagccggaagtgaccgggcaaagcgcgccgtatttgtctgcggcgctgatcgagctgttcagactcgcggaagaagaaatgcgcgcgctccaggacgagtacatttcggttgaacatctggcccttgctgtcatggatgtcgaacacgatgacctgtcccggtatttgaaaagcaggatcacgaaacagcaactgcttcaggtgatcaaaaacataagggggaatcaaaaagtggcctcgcaaaacccggaagcaacctacaatgttttaaaaaaatacggcactgaccttgttgaagccgttaaagccggaaaaatcgaccctgttatcggccgggatgcggaaatccggaacgtcatccggattttatcacggaaaacgaaaaacaaccctgttctgatcggcgaacccggcgttgggaaaacggccattgtcgaggggcttgcccagcggatcgtcaggaaagatgtcccggaaggcttaaaagacaaaacgattttttcactcgacctcggggcgcttgttgcaggcgccaagttcaggggggaatttgaagaacggctgaaggcggtattgcaggaaattaaaaaaagcaacgggcagattttgctgtttatcgatgaactgcacacgattgtcggcgccggcaaaacagaaggggcaatggatgccggcaatatgctgaagccaatgcttgcccgtggtgaactgcactgcatcggcgcgacgaccctgaacgaatatcggcagtatattgaaaaagatgcggccctcgaacgccgtttccagcaagtgctcgtccaggagccggatgtggaggatacgatttcgattttaagagggttaagggaacgttttgaaatccaccacggcgtccgcatccatgacaaagcgcttgtcgctgcagcaacattatcaaaccgttatattaccgaccgttttttgccggataaggcgatcgatcttgtcgatgaagcctgcgcaaacatccgtgttgaaatggattctatgccgacggaactcgatgaagtgacaaggcgtgtcatgcagctggaaattgaagaagccgctttgcaaaaagaaacggatgaagcaagcaaagcccgccttggcattttgcaaaaagagcttgccaatttgaaagaagaagcgaaccggatgcgcgccaaatggcaggctgaaaaagcggaattgcaaaaagtacaggaaaaacgggaattgcttgaaaaataccggcgcgatcttgaagaagcggaaaaccggtatgatttgaacaaagcggctgaacttcggcatggcaggattccggccgttgaaaaagaattaaaacagctcgaacagcaaatggcggaaaaagaaggcagcgggcggattttgcgcgaagaagtcacagaagaagaaattgcagcgattgtcgcgcgctggacagggatccctgtggcaaaacttgtgcaaagcgaacgcgaaaaactgctaaagctggaaagcattttacatgaacgcgtcatcggccaggatgaagctgtccgccttgtcagcgacgcggttctaagagccagagccggcatgaaagacccgaaccgcccgatcggatcctttatttttctcggccctaccggcgttgggaagacagaacttgccaaagcactggcacagcatttatttgacgatgaaaatcatatgatccgaatcgacatgagtgaatatatggaaaaatttgcggtctcgcggctgatcggggcgccaccgggatatgtcggctatgaagaaggcggccagctcactgaagcggtgcggcggaaaccgtattccgtcattttgctggatgaaattgaaaaagcccacccggaagtgttcaatatcttgctccaggtgctcgatgacggccgtatcactgattcacagggacggacggttgattttaaaaatgcgatcgtgatcatgacgtcaaatatcgggtcgtcctatttgctcgatatcaaaggcgatgacatcagcgaagagacgaaaaatgcggtgatggcacagttgcacgcgtcgttccggcccgaatttttaaaccggattgacgatatcatcttattcaagccgctcacgctggaaaatatgatgggcatcgtggataaaatgatgcacgaattggctgcacgcctcgctgaacaatcggtcgggcttcagctgtccgatgaggcgaaaaaatggattgcggaatcggcctatgatccggtgtacggggcacggccgttgaaaaggtttatccagcatcaaattgaaacgaggcttgcaaaagaaatcattgcgggaaaggtgaagccgcatcaaaccgtcacgcttgatgtgaaagacggcgcgcttcaagtgacaaccgaatcatgatgaaaaaaccgggaggcactttgaatcagcgcctcccgatttccggtgaggggtgttttgatttaatgttcgggacttgtgtttttcggcaatgctgcattgacaataaatgcagcagcggaaatgacaagcgacataatggccatcgttttcatgctgtaatgcgagtttgacatggcactgccaacgtagccgagcatttggctcagtaaaaacacccaaaaaatcgttacgatgtatttcatactttcaccccgattgaaaaacactttttaaatcaccctttatcttatcacagccgcagtcattggaaaaggggaacccggttgccgcggatgaaatttttcccgaaggctggaacgaaaaatgggcacagcggccttttgtccgttttggatcgtccggaagtatctttacggcgggaaaagcatatgcttgaataaagatgaatggagggccggccatgaatcaagcacttgtcattggtgccggggcgttcttcggatttgagctgtgcaaggcactgcttgatgcggggtatccggttatagcggctgatcaagaaacggatcccgggtttttgttggaagaaagatggatggaaatcggaagaaatgccaatttggattaccagcctctgagccggttgtcgccggaaaaatgcacatgctgtattccggtatacgattattatgtccgggatgcccgtgaagatttacaagatgcatgccgctttttagaaccgtttaaagcgcaaatcgaacgtgtggcactcattcttccaaaccatctggcggttgcggaacaggcagaatgggttcccggcgtgcttggcgattgcgcacgcattaccttttttgttccggcactgttcggccccggtcagcccgggagccttgctttttcccaaatgattaacgggaatacggaaccggacttgaaatatgacgaccgcgatgccctttttgcagcagatgccgcagtggccattgtctccgagcttgaaaaaggggaaacggggaaagccttttatttaaaaagccctgacggaaacggatgggagcctgtcgcccggtttttaacgcaggatacaggcagccccacgcttccttcgtgcaggcttgaggcaaaaggtgaactggaaccgatgatcgtccggccgtccgtttcctggcaggccgcgattcaacagcaaatcgcctgtcaacggaagaacagctaaagaacgctaatcttccttttcaaaatgggaaagccacttttcaaaaaccggcgtgattttccggaacaacggcttaaactcctcgaaaatgccaacgactttgtcagcttgatccagcaacgcttccatgtccacattgcggaaaaaagaaaggtcaaacaagccgccgtttatttcttcatctgcttcttcctgtccggtcccgggcggctcttgccgcttttgcgggaaaaacatccggtcaaaagggtggattttttcatgttcttccattttttcacttcctttccttcttttttgccaggatgagggcggtccggatctatgatcagcatatgagagaaaaactgaatcggcttgcatcaatggcccggatcttaaagcgggaggaaaacaagcaccatgcgatccgcgcggctccgccctattggtagcacgttttttcatcccgccattgtgggcatggcccgtattttcttctattcgtgacaagcaaacagggctttgttataattaggagcaggtcataatattgtgcgataaggaattatgccgctttgattattttagtgaaagaaggaatgcaaaatgaatgctggcattatcggtgtcggaaaatataatcctgaaaaggttttaacaaatgcggactttgaaaaaatgatggacacgtcggatgaatggatccggacgagaaccgggattgaagaacggcggattgcagcggatgatatggagacttccgatatggcatatgaagcggctgtaaaagcggtgaaacatgcaggcatttccgcggaagagctcgacttaatccttgttgcgaccgtgacgccggatcagccgtttccgacggtttccaatattttgcaggaccgcctcggcgcaaaaaaagctgccgcgatggatatcagtgcggcctgttccggttttatgtacgggcttgcgacggccaagcaatttattgagacgaaaacgtataaatatgttttaattgtaggtgttgagaaattatccaagatcacgaactgggaagaccgcagtacggcggtgctgttcggcgacggggcgggcgcagcggttgtcggcccggtatcggaaggcaggggcatccttgcttttgaactcggttcggacggttcaggcggaaaatatttgtatgaagataaaagtggccatattgtcatgaacggtcgtgaagtgtttaaatttgccgtccgccaaatgggcgaatcaagcgtgcgcgtgatcgaaaaggccggcgtcaggaaagaagacgtcgatttcttaattccgcaccaggccaatatccgaatcatggaatctgcgcgggaaaggctcggcctgccggtggaaaaaatgtcgaaaacaatccacaaatacgggaatacttcggcagcatccataccgatttcattggtggatgaactagaagaaggaaagatcaaagaggatgacctcatcttgatggtcggcttcggcggcggactgacctggggagccgtactgatcagatggggacgataacacgcttaaatgcagcatacagattgtaagaaacacggtcttcttataccaggaaaaggagatggcataatggaaaaaagaagagtggttgttacgggaatcggggctgtcacgccggtcggaaatgatgcgcggacagcctggcaaactgtgctggacgggaaatccggcatcggcccgctgacaaggctggatgcggaccagtttccggcaaaagtggcagctgaagtgagagactttaacatcgaagaatttattgaacgaagagaagcccgcaaaatggaccgttttacccattatgcggttgcatctgcactgatggcggtagaagatgccggacttacgatcaacgaagaaaacgcaacccgtgtcggcgtctggatcggttccggtatcggcggcatggaaacattcgaaaaccagtttgaagtattccaaaagcgcggatatcggcgtgtgagtcctttctttgtaccgatgatgattccggatatggcagcaggccaggtctcaatcattcttggcgcaaaagggattaactcttgtaccgtcacggcgtgtgcaacgggaacaaactcaatcggggacgcctttaaagcgatccagcgcggcgattgcgatgctatgattgcaggcgggacggaagcgccgattacaagaatgtcgttcgcgggattttgtgccaatacagcgctgtccaccaatccggatccggaaacggcaagccgcccgtttgatttaaaccgggacgggtttgtcatcggcgaaggcgccggcattttggtgcttgaagacttagaacatgctttaaaacgcggagccaaaatttatgcggaagtggttggctacgggtcaaccggggatgcctaccatattactgcgcctgcgcctggcggggaaggcggcgcgcgctcgatgcaaatggcgcttgatgatgctggccttgccccggatgaaatcggctatattaatgcccatgggacaagcacgccgtataatgataaatacgagacaatggcgattaaagaggttttcggcgaccatgcttacaaactggccgtcagctcgacaaaatcgatgacaggccatctgctcggggcagcaggcagcgtggaagccatttttactgtgcttgcgatcaaagaaggcattgttccgccaaccatcaatattcaaacgcctgatccggaatgcgatttggactatgttccggataaagcgcgcaaacaggagctgaacgcagcggtcagcaattcgctcggtttcggcggacacaacgcaacccttgcttttaaaaaatacgaagcctgatccaaaaggggtatcccggttaaaatgggataccctttttgcatggaaacgaaaccaaatattgcgaaacgtttttcaaggatcacgtgctagaaaagccgagtcgcaaaaaggggatggaacatcacatgcggttccgataacgttttggcatggggatcaaagggtgcggacagactcccatgctggcggtttcaaaagtgtgatttttgcgggcggaaagatgaatttacaggggaaaaaacgcattccgggatgtgcggcagtctgctctggcttttgaaaaatttattttctaaaatccggtcttccgcaataaaataaagcaaacgggagggggaaccggcgatggggatcattcggacggatttgtggatggaagaagctttctcaaaaccggagctgtttttagaaacaatcaaacaggaaagggaagatccggaagatttttatcgctacttgcagcgtttcggcatgtaccgcccttcaaggcaggcagaacagatttttactgcgttgaaaaaagcggatgcctgggagaaaatcggggagtatcatgcaaaatacaaaaagctttggaacgggccagatccggacatttacatttttccagtcaggaatggaaacggtttcaactttggccgcagccgcggaaaatcgggcgtaacactgccgggtgccgtttttttatttcttgcaccggttcgggaccggaaagaatgggaagcgctgtttgtccatgaataccatcatgcggcaagaatgagcaggttgaaaaaaccgctgcgtgattatactttgctcgattccctcgtgtttgaaggcctcgccgaacatgccgtgctcgagtatgtcggagaagaatatgtatcggaaacatcaaaacgctattccgaaaaacagaaaaaacatgcgtggcaacagtttttcaaaaaaaatcttgcagccggaaaagaagaaaaaattcatgatgaccttcttttcggcagaaaatacgtcccgccgatgatgggatatgcgctcggataccatttgatagagaagtataaaacggcccattctttttctacaatagcaaatctcggccgccgttccgaaatatttgcagaaggaatgtttaccaacccgccggaatcctgaatccataaagtaccaaaaaaatacaaatataattttaactaaaaaaatgattgcgtttcttttaattttgtaatattatttaaacaataaattaataagattttaatctattttcgttttttctacttttacgaagggaggttttgtatattggaaaaaccaccgcttttgcaaattgaggatttgactgtttctttccaaatccaggatacatactatccggcagtcgatcacgtctctttaaccgtcaacgaaaatgaagtggtggcgattgtcggggaatccggctgcggaaaaagtgcactcgctctggcagtgatggggctgcatccggaagaaaagacaaaagttgaagggcgcattctctttaaagggcaggatctcgtgccgctcgggactgggaaactgaatgaaatccgcggggcggaaatgggcattattttccaggatccattgactgcgctgaacccgctgatgacggtcgggcggcaaatagaagaaagcatggattaccacaccaaactatccggttccgaaaagaaaaaacggacgcttgaattgttaagccgggtcgggatcccttatcccgaaagaacatataagcaatacccgcatgagctttccggcggcatgaggcagcgggtggtcattgccatcgcgatcgcctgccagccgtcgcttgtgattgcggatgaaccgacaaccgcgcttgatgtcacgatccaggcccaaattatggatttgctgaaagatttgcagcgccagatgaagacgggcattattctgattacccatgatctcggcgtcgttgccgaaatggccgacagagtggccgtcatgtatgcaggcgaaattgtcgaaattgcggatgttacaacactcttcaaaaatccgttacatccttatacccgttctttgctgaattcaatcccgtcggcgacggaagccaaagaaagattgcatgtcatccagggcattgttccttcactgaagaacctgccgcgctcgggatgccgctttaaatcaaggattggctggatcagcgacgcggcgcacgaagaaaatccggttcttcgcgaagtggaaaacggccactgggtgcgctgtacctgttacaaacatttttatttcccggacgaacagaacatggagacaggggatatgtatcatgccacttcttaagatcgaaaatctaaaagtctattatccggtacggggcgggtttttccgccgggtggtcgatcatgtaaaagcggtcaatgatatcagcttcgaattgcagcctggagaaacgtacgggcttgtcggcgaatcgggctgcggcaaaacgacaacgggcagaacgatcgtcgggctgaatcatgcaaccgcgggcaaaattgtgtttgaaggaacggatttggcccggctcagccggaaggaatttcaacattaccggaaagatatccaaatgatcttccaggatccgtattcttccctgaatccgaaaaagcgcgtggcggatattatcgctgaaccgattcgcaattttgagaaactgccccgcgaacaagagcgggaaaaagtccgcgaagtcatggaaaaagtcggcctgagtccggactccatgtttaaatacccgcatgaattttcaggagggcagcgccagcggatcggcattgcccgggcgctgacattgaatccgaaactgatcattgcggatgagccggtctccgcccttgatgtttccgtccaggcgcaggtgctcaattttatgaaagacatccaaaaagaattcgggctcacctacctatttattagccatgaccttggcattatccgccatatgtgcgaccgaatcggcatcatgtaccgcgggcgttttgtggaagaagggacgagtgacgaaatttacgagaatccgcaacatatctacacaaaacggctgctgtccgcgattccaaatggggacccggaaaatagagcagcacaaaaacagtaccgggaaaaaatcaacaatgaattccggcaagctttcagggattattttgacgaggaagggaagccgtaccatctcaagccggtttcgcatacccattccgtagcactgccgtaaagaggggggcacagttatgattaaatttatattgcgcagaattctcatcatgatccctcaattaattattttgagtattttgattttcgtgctggcaaaggccatgcccggcgatgcactgaccggccggctggcgagcaatccgaaaatggatatccacacgcttcatgaaatgaaagaaaaattggggctgtatgatccggcttatgtacagtacgcccgctgggtgaaaaatctcttcaaaggcgatcttggcatgtcttatattcaccagcagcctgtaacagaactgcttgccgggcgactgtggaacacgattttactgtcggcggtgattctgatcctgacatatttgatcgccattccgcttgggatcgtggccgggcgatggacggattcatgggcggataagctgattaccggttataactatctcagctatgcaactccgctgtttatctttgcattgattatgctgtttgtgttcggttttgtcctatcatggtttccgacaagcggcagtgtcaatatccaggcccgtgacggcacgtttgaatatttcatgagcaaggcttaccatctaattttgccagccttatccggatcgctgcttgcaacggtgggcacgatccagtatttgcggaatgaaatcatcgatacaaaaatcaaagattttgtaaaaacggcgcgggcaaaaggcgtgcctgaatcgaaggtgtatacgcatcatattttaagaaattcgcttttaccgatcgccacctttttcggttatgagattaccggattaatcggcgggtccgtcattttggaatcgatattcggttatccggggattgggcagctgtttttgcaatcgattatgcagcgtgattacagcgtagtcacggcgctcgtcatgatttccggcgtggcgaccttgttcggcacattattatcagacattattttaagcgctgtggatccgcgtatccggattgagtaacggggggtgagaggatgaaagcagtcatttcaacacaacagcccgcaactgtcgaaacagaaaaaagcccgtccggattttcgattatctggcgggaactgatcaaagataaaatggccgttatctccatgatcgtgctggggctgattctgataacagtttacggcatgtcattgattttaaacgaaaatgagattgtaaaggttgaccttttatccatttacgcaccgccctcagctgaacactggctcggcaccgattacggcggccgggatatattcgggcaactgattatcggtgcaaaaaattcgtttacaatcgggcttgcgattacgttgattaccggtgcaatcgggcttgcggtcggattaattgccggttacttcggcggagtcattgacaatatcatcatgagaatcattgactttattcttgtcctgccgtttctcatgctcatcattgtcctcgtgacaatcgtaccgaaatataatgtgttttcttttattctcattatgagtgcattcctttgggtcggaaaagcaagactgattcgttccaagacgctttcggaaagggaactcgactatgtcagtgcttccaagacgctcggtacgccggactggaaaattattctcttccaggtcctgccgaatttgagctcgattattatcgtgaacttgacgattaacttggcaagcaatattgggattgaatcgagcctgacctatctcggcttcgggttgccggaaagcacaccgagccttgggacgttggtcagttatgccacaaacccggatgtgctccagcataaatggtggatttggttacctgcatcgctcctgattctggtgatgatgctgtgtataaattttatcggccaggcgttaaaacgcgcagccgatgcaagacaaagacaaggataaaaaagagggggcttagcaatgaggaaaagaaaatggtcaagcgtattcagtttgctggtgatactcgtattggtgctgtcagcctgtaacaattcaccgagcagcggaagcaaggaagacaaggcagtgaaaacggaagatttaacaagcaagtttccgaataccgtcaaaaacaacaaaaaagcgattgacggcgggattttgaattacggcatcgtttccgatacgccgattgaaggcacattcaaccttgctttctacgaagggcaaccggattttgaagtcattaaattttttgatgattcgctgttaaaaacagacgaaaactatgaatttacgaatgacggcgccgccacgtacaaattgtccaatgacaacaaaacaatgacgattaaaatcaaagacaatgtcaactggtctgatgggaagccggtaaccgccgaagacctcgaatttgcatacctggttatcggaaataaagactataccggtgtgcgctacggcgatgctctgttccaaaatatcgtcggcatggatgaataccataaaggaaaagcgaaaaacatttctggtgttaaagtaatcgatgataaaacgatttccattacctggaagagtgccaacccttccgaaaaaacaggcgtctggacaacaccgcttccgaaacattacttaaaagatgtgccgatcgcaaaaatggcacagtcggataaaattcggttacatcctttaggcttcggtccgtttaaagttaaaaaagtggttccgggcgagtctgttgaacttgtcagaaacgaccattactgggcaggaaaaccgaaactgaaaggtgtcgtcatcaaagtggtcaatccgaaagtggtgttacaagccttgaaaaaaggcgaaattgactatgctgctttcccggtagaccaatacgaggctgctaaaggtgtaaaaaacttccagctgctcggcacgatcgatttggcttacagctatatcggatttaaactcggccactgggatgcaaagaaacaggaaaacgtcatggataacccgaaattccaaaataaaaaactgcgccaggcgatggcgtatgcgctcgataacaagtcagtcggcgaaaaaatctaccacggtttgcgtttcccggcgacgactttaattccgccatctttcccggaatggcatgacaagtccgcaaaagggtacacgtatgatccgaaaaaagcaaagaaactgcttgatgaagccggttataaagatgtcgacaaagacgggtaccgtgaagatccaaacggcaaaaaattcgtcattaatttcctttccatgagcggcggggatacggccgagccgctggcaaaattctatatgcagtgctggaaagatgtcggcttaaatgtcaaacttgttaacggtcgtcttgctgagtttaactccttctatgatatggtgcaaaaggatgacccgaaagtggatatctatgcaggtgcctggggaacaggtagcgatgtggacccgtacggcttgtacggtcggaacgttatgtttaactacacccgctttgtcagcaagaaaaatgatgaactgttggaaaaagggcattctccgcaagcctttgacacagcataccgcaaaaaggtttacaatgaatggcagaagtatatgaatgaggaagcggcagtcattccgaccgtttaccgttatcaattgtatgcggtgaacaaccgcgtgaaaaacttggctgtatatccggatgaaacacaaacggattggagcaaggtgagtgtcacatccgaaaaagcggacacccaagaataatccataaaggccctgtctttggcagggcctttttcctttccggcttgccgggatcgggagagcagagcgtctttttaaagcagagcctttatcctttccgacttaccgggggagggaaaacgaagcgtcttttaaagcaggccttcttccttttcgacgcggtgggattggggttcttctttttacaagcgaagtgcaatctttattttctacacagcggaatccggaaaagaaggaataatttaactgccccctgcctatactgaatgacaaacagagtatacggggggttatccatgctgtatcttcacgatatatgggtcaactggttcgagggggaggaaaacagttataatgtctgcccattccatgagtggcggagggacgatgtgattgaactgctggaccaggtgccgcttttatttgtggacacgcttttatacgagtacattgaaaacgatttggctgaactgccgcaaactttgctgaatgatgttttccagaaggcggttttgcgcaaaaaccatgaacgaatccagctggaatattgttttgtcgtgacggatggaaaagggattttggcggtggatacgatcggctatacgctaccgatccgcaaaagccggctgattccgaggcaggaacagcttgtctatgaaatgatcgaagggcatgaaccggtgtcctatccgtttgaaaaccgcagcaatccgaaagaacatcatattttatccccgtcgccggagtgcatgcaggggctgacaagaagggaacgacaattaaagcagctgttatttatggcgctcgaccagctctattcctcgaaaaatacggcggaagtgcggtactggtatacagagtggtgcccggagcagtatgaacacatccagtttatgccttttgaagatgcgtgggagcggctttatgcagaaacaaaaacaggctggtccaaaaagcatgaacagttgtgcgaaaatatgatcaaagggcagcctttttttgaaaaactatgggaactggaacacaatgaaaaaagcgaactgatgtaaaaacgagttgcgaaacctccgcaactcgtttttttcttaatggcgtttttttctgcccaatcccatcgcattttccatttttctcagcatatttccggctacaatactggctttttccgcgccttcatctaaaatccggtccagttcctccgattcaatcagtttataataccgtttttggatcggggccagcccttcattcactacatcaacgagatccgctttaaacgcgccatagccgacgccgtcatatttccgttccagctcttcaatggtcaagctgctgaagttggaatagatgtcgagcaaattggaaatgcccggtttccgctctttgtcgtatttgaccacgccttctgagtctgtaaccgcgcttttaatctttttgtcgaccagtttcgggtcatcaagcagcgagataaatgcttttttattcggatcggatttgctcatttttttcatcgggtcctgcagcgacataatccttgctccggaattggaaagcttaatatccggcagcgtaaaaatttcgaggtaacgtttattgaacctttccgccaaatcccttgtcagctcgagatgctgtttctggtcctcaccgaccggcacaagatccgtgctatacagtagaatatcagcggccatgagcggcggatatgtgagaagcccggccgatacgctttctttccctgcagatttgtctttaaactgcgtcatcctttccaactcgccgacataggcaacgcattgcagcatccatgcggcctgggcgtgcgccggcacttccgactggataaagagcgtcgctttgttcgggtcaatgccgactgccagataaaaagcggcaaggctcctgatgtttttgcggagttcaaggcggtcttgcgggacggtaatggcgtgctcgtcagcaatgcaaaaatagcaattaaagctgttctgcaattccacaaactgcttcattgacccaagatagttcccgatgtggatcgttccactcggctgaatagctgaaaaaatcgtcctcattttttcttcctcctaaagcatggatatttttccagaaaaataaaaaacccattcaaccaaaattagggacgaatgggataaatccgcggtgccaccctaagtgcccggcaatacgggccgcttagttccaatgccaattggagcctggttaacgcaaggcgtacgccggaaactaatgaggcggccgcccgttcatctccggagctcgaaagcccattccacctgcaggcatgtttgtttccaccagccacaaactctctgaaaagccataaacagatgtactcttctttttcatcgcttctatataccagtatcattataatgaaaagatggaaaaatgtcaaaaaccgctgtccgccaaggcccattttatgtaggattccgtctttgcctgatcgttttaaacggccagcattttatgacgaactttgcagaaaaagggcgatggccatcagcaccatcatggacaccccggtaagaaaaggcatggaaacacgcaaggtaaccagcttcgacagcgggcggacgtcctcctcgttaaatttagaagacattctttgaaaaccgtaaacaaacgcgtcaaaaaaaccggtccgcgccatgaaaaccgatgcggcaaaaagaatcaacagtgccccgatcgtaaatgaagtattaatatagctaagcaaatcgatccgcttatacaccaaaaaagaaaaaaacaaaacaagcaactgggaggccagcaaccagcagacaagctttttgaacatacgctcacctacaaaatgattttcattcattatacaggaacaaaagaaaagatgaaatagcggaaaatctaaacctaaattaaagttaaattaaatttattaaaattaatgaaaaaattataaatacaacggaacgcggaagttaagcgtttgttaacgctttcaaacaaaaaacattgttaaaaaacctaccaaagtttatttattttaatagttttatttataatttttttaaccatttgtaaggggttacaatattgagatgacaatatctttttggtttattactccttttacgtaattaaaaaagattaaaaaaacatgtacaagaaagtgaaatgttagtataattaaattcgaaaagtcactagcttttcagaaaaataaaaaaagggtggttagctgatgaagaagtcaaaattttatgtgtttatgacgctggcttttgccctgtcgctcgtcctcggcgcatgcggcggcggaagcaaaaacagcagctcaggttcaagcagcggttcatccaaaaccaagcaagtgctgaatatggatgaaacggctgaacttccgacaggggatccgacacttgcaacggatgcggcaagctttaccgttttcggtaatacaatggaaggcctttatgtcgttgggaaaaatgatgagctgaaactcgggattgcgaaagaagaaccgacagtcagcaaagacggcaaaacgtatacatttaagctccgtaaagacgcaaaatggtcaaacggtgatccggttacagcaaaagactttgtttactcttggcaaagggctgtgaatccgaagacagggtcgcaatatgcttatatgttctttggtgtcgttaaaaacgcttcggatatcaatgctggcaaaaaagatctaagcactttaggggtaaaagcgattgacgatcatacattgcaagtccagcttgaaaaaccggttccttacttaaaatcattgctggctttcggcacatatttgccgctcaaccaaaaatttgttgagtcaaaaggcagcaaattcgggacaaacagcgacaatatgctgttcaacggcccgttcgtattaaaagactggaacggcacaggcttgacatggaaatacgtgaaaaacccgaattactatgacaagaaacatgtgaaactgagccaaatcaatgttcaggttgtaaaatcgccaagcacaggcgtcaacttgtacaatacgggcaaaatcgaccggactgttttgagcgccgaatatgcgaaacaatataaaaataacaaagaagctgtgacaaatccggagtcaagcgttttctacttcaaatacaatgaagttagaaacggaaagaaaaccgctttagcaaacaaaaacatccggatggcactggcgatggcttatgataaaaaatcgtatgtcgacacggtcttgtctaacggttcgattccggcaaacgggctcgtgccgaaagactttacaaaagatccgaaaaacggcaaagatttccgtacggaatcgggttcttacctccagtataacccgacagaagcaaaaaaatattgggaaaaagggttgaaagaactcggcaagaagaacttaacgcttgaaattctcggtgatgatacagataacgcaaaaacaacaggcgaattcttccaaaaccaattggaaaagaatcttcctgggttaacgatcaaactgaaaaacgtaccattcaaaaaccgtttgcaattggatacaaaccaagattatgacatccaggttgccggttggagtcctgactacaaagacccgatgaccttcctcgacttgtttgtaacaaacggcgataacaacaaatccggctattcgaataaagaatacgataagctgattgatgaagcgaagaacaaatacggcaatgatccggaaaaacgttggcaaatcatgctgcaagctgaaaaaatcctgatggacgatgcggcgatcggcccgatttatcaacgtgctacattacgccttgttaaaccgtatgtaaaagggatcgagtaccatacattcgggccggattacacgtttaaagatgcatatgtgcaaaagtaagaaaactgcatgacctcaattaaaaaggtaaaagagagtattttctttccgaaatactctcttttcaccgttaagaggatttttatgtgaaaaatttaaacattccttttctttgggaggtgtcacgtgtgacgaagtacattgtgcaaaggattatttatttgtgcattaccttattaattattgcttcttttacgtttttcctgatgaaatttttgccggggaccccgttccggaaccagcaaaaattatcaccggaacaggttcatatcctgaaccagaaatacgggctgaatgaatctttgcctgtccagtataaaaattatatggtgaatttgctgaaaggggatctcggcgtttctttccagtttgacaaccagccggttacgcagctgattgtggaaaggatgggtccgtccttgcagttggggcttcaggccatgattgtcggcacgttaattggcatattactaggcgtactggcggcaatgtttcaaaacacatggattgactacggaagcacatttctttcggtcctcggtatatccattccctcgtttgtatttgccgcagtcctgcaatatgcgataggcgcgaaactgcaatggctgccggttgcagcttgggatgggttcgcctcttccatattgcccacgattgcgctcgctatttttccggttgcaacagctgcacggtttatgagaacggagctgattgaagtgttcggttccgattacattacgctggcgagagcaaaagggaattcttacgggcaaatcgcctttaagcacgcgatccggaacgcgctgattccgcttattacggtgcttgggccgcttgccgttaacttgatgaccggatcgatggttgtggaacaaatttttgctgttcccgggattggcgaacaatttgttaaatccattcaaatgaatgattacccgattattatggggacaaccctctttttctcattcctgttagttttgattacattagttgtcgacattttatacggtgtcattgacccgagaattcgattggccggggggaataaatcatgaacaacaacgtagagacattgccgaaagaattatttgaacccgcagccccggatcgcgaacaaagtgagttgatcgccaaaccgcaactgtcctttatgcaggatgcatggatgcggatccgcaaaaacaaaggcgcggttgccagtctgtttgtgattgtgattttaattttgatggcgattattgggccgcatctttccaaatcgggtccgtacgcacaagatacttccagggcgaatttgccgccaagaattcctgtgattgaaaagctcggcatttttgatgggtcccagacggttggcgggcaaaaagtgaacatgtatgaacaaaaccatattcatacgtattactggttcggcacggatgccctcggccgcgacttgtttgcaagggcatggcaaggaacgagaatttccttatatattgccttccttgcggcgttgatcgatatgctcatcggcgtttcttacggcctcatatccggatacaaaggcgggcaggtcgataacgtgatgcagcggattattgaaattttgtccggtattccgaacttgattgtcgtgattttaatgcttttgatctttaaaccgggaatcttttcgatcacgattgcgatggtaatcaccggctggctgaatatggcacgggttgttcgcggccaggtgttaaagctgaaaaatatggagtatgtattggcggcaaaaacacttggcgcttcgaacatgcggattttatttaaacatctgctcccgaatttgaccggggtgattattatcaataccatgttcaccattccaagtgcaattttcttcgaagcctttttaagtttcatcgggatcgggctccagtccccggctgcatcgctcgggacattgattgaagacggttataagacattccagttcctgccgtatttgatggcagtgccgggcacgattatttgtttgctgcttgtcgccttcaacctgctggcagacggtttacgtgatgcatttgacccgaaaatgcgcgattaagaaatgaggtgaagccgaatggaaaagattttgcaagtgaaagacctgaatatatcctttcacacttttggcggtgaagtaaaagcgatccgcggtgtgagttttgatttatataaaggggaaacattggccatcgtaggggaatccggttcaggaaaatcggtgacgacgaaatcgattatgcgactgttgcctcctaacaattcggaaatcaagtcggggcaaatcctgttcggcgacgtcgacattgccaaagcgtcagaaagaaagatgcaatcgatccgtgggaaagagatttcaatgattttccaagatccgatgacgtctttaaatccgaccatgacaatcgggaagcagattatggagccgcttttgaaacaccagaagatgcataaaagtgaagcaaaaaaacgtgccattgagcttttgaagcttgttggcatcccgaatgcggaaatccgtgtcaaacagtatcctcaccagttttccggcgggatgcggcaaagggtcgtcattgcgattgctttggcgtgcaacccgaaaattttaattgcggatgaaccgacaacggcacttgacgttacgattcaggcgcaaatccttgaactgatgaaaaaactgcagtctaaaattgatacctccattatttttattacgcacgatttgggcgtggtggcgaatgtggcagaccgtgttgccgttatgtacggcggaaaaattgtcgagatcggaaccgtggatgaaattttttataatccaaaacatccgtacacatggggactgatcagttcgatgccgagccttgatgtcaaggatgaagaactgtacgcgataccgggcaccccgccggatttattgaacccgccaaaaggggatgcctttgcgccgcgcaatccgtacgcacttaaaatcgatttggagcaggagccgccgatgtttaaagtgtcggacacgcattatgccgcaacatggctcctgcatccggatgccccgaaagtagagccgccggaagccgtgaaaaagcggatgtacaagtttaaaggaaatgtgcgcccgataccggctgaggaggggaagtaagatggcagtgaaagaaaaactgatcgaagtcaaacatttaaaacaatatttcaatgttggaaaagcaaatgaagtccgtgctgtcgatgatcttacatttgatatttacaaaggcgaaaccctcggacttgtcggcgaatccggctgtggcaaatcgacaaccggacggacgattatccgcctttacaatgcaacggcaggagaagttttgtatggcggcaaaaatgtccatgccaaaatgtcccataaagaactgaaacattttcgccggaaaatgcaaatgattttccaggacccgtatgcttccctcaatccgcgcctgaaagtggccgatgtcattgcggaaggaattgatatccacgggcttgcaaaatcaaatgaagaacggatgcaccgcgtttatgaactgctggaaacagtcggcttaagcaaagaacacgccaaccgctatccgcacgaattctcgggcgggcaaaggcagcggatcggaatcgccagggcacttgcggtcgatcctgaatttattattgctgacgaaccgatttccgcgctggacgtctcgattcaggcacaggtcgtgaacctgttgaaaaaactgcagaaagaacatgatttaacgtatttgttcattgcccacgatttgtcgatggtgaaatacattagcgaccggatcggcgtcatgtatttcggcaagcttgtggaactggccgatgccgatgatttgtataaccatccgcatcatccgtacacacagtcattgctatccgccatcccgcttccggaccctgattatgaacggacacggcaacggaaaatttacgacccgtccgtccatcaatacaaggaaggcgaagaagtaaaaatgcgcgaagtggcaccgcatcattttgtttactgttcagaaagggaactcgagcagtacaaaaaaacttatcatggctaatcattctcaatgggaagaagaacgcatgccggttgaaatgcgttcttcttctcactttttttataaaaaaatgaagaatagtggtttaaatagagagaattggggaaaaagaagactattaaaccggtggaaaaatacaacaaactatttttcaaaaaaatatattcaatcacgcggatatagtgtataatacataatagagattgtttgattaaacttattttaatgtgagaatcaaatgggaatccaaatataaaaatttaggagtgtgaatgctagatggtcacattatacacttcaccgagctgcacatcatgcagaaaagcaaggaactggcttgaagaaaaccatattgagtataaagaacgcaacattttttctgaaccgctttcactggatgaaattaaagggattttgcggatgacggaagacgggacggacgaaattatttccacccgttcgaaaacattccaaaaattaaacgtcgatctggatgccctgccgctccaagaattgtacacattgatccagcaaaaccccggtttattaagaaggccaattatcgtggatgaaaaacggctgcaggtcggctataacgaagatgaaatccgccgcttcctgccgcggaaagtgcggaccttccagctaagggaagcacaacggcttgtcaattgacaacttttaatatttcttttgccggatgccttttataagcgtaaaccggcaaatcacctcccaggttccggcccgggaggttttcttcacctttttgtcataaaattgtcaaataacgaatatgtatttagaaaattttgtcttgaatttctgcagcaaatcggatacaatacaaaaaagatgtaaatgatcttttttgccggatgtttaagaaatgggccggcgtggaattttaaaaaggaaagtttttttatttccatttgccagtattttatcataaaataaaagtacaaggttacctatacctgaatgggggaacatgtcccttcactacatctgcaagaagggagagttgatgtatggaaatcgaaagaatcaatgagaacacggtgaagttttatatttcgtacgttgatatagagaaacgcgggtttaatcgtgaagaaatctggtatgaccgggaaagaagcgaagaattgttctgggaaatgatggatgagattcacacggacgacgatgtatttgacccggaaggcccgctttggatacaggtgcaggcgctcgaaaaagggctggaagtgcttgtcacgaaagcgcagttgtcgaaagacggacagcgttttgagttgccgattccggatgagaagctgaaagaactgccaatcggcgaccagcttgaggaatttttcagcgagaacttccaaacgccgatgcagcaggttttcacggatggcgatccgctcgaacaggtcttgtatttcaaggactttgaagatttgctggcgctggccaaaaacgtccggatggaagacgtcagcacgaagctgtacgtctttgaaggcaaatattatctgtatgtccgcttcccggaagatgtaacggaagaagctaatgactttaagttaagccagctgctggagtattccgatctttcctctgtcaccagccatcgtctgctggaatacggaaagccgatcattgacagcaatgtatttgcaaaattaaactcgtacttttaatcgataaaaatcggtgcgcaaacgcatcgatttttttgtttatccggaaaaaattcatcctggcaaacaggatttttcgccccgggtggtgaatgtattcaatacggctgtgcatggcgtttatacagataagggccggtcaatctaaggcttgcggagaggccggcaactgcatacgaccgaatgccacggccaaacaaaagcgggactgccggctagagggcccgcctacagttaaaaaaggagaggatgccgttgctttctgcgctaaacgagcggggggagctgatcatgctgacggaacgctttacaagattggatctaaagcagttaaaaacctcccatacgttttactgtcgggactgccgtgaacccctcattttaaaaatcggcagccgtgtcaccccccatttttcccattaccgccattccacttgtgccacattttctgaaccggaaagcccgatgcatttgcaaggcaaaaaagacttgtttttatggttgagggggcaggggctcgatgtttccctcgaacaatattttccttctatccggcaaagggcagatcttgtggtgcgcaaataccggcagctttttgccatagaataccagtgttccccgatcccgtttgagcggctgatggagagaacggaagggtacaggcacctcggcattttgcctgtttggatactgggcggtatgcctttccggtcctcagggaaagaggcggaaagcgtgtaccgttgcagcgattttcagttgtcttttttacggcatacccggcaccacttttatttattcagctatcctcccggcaaaaagaaggtctgcctcttgtcccacatgacgcccatatccgccaaaacgttccacgcctgttacgcggaaaagccgctgtctgccttttcttttccgtttacagatgaccagttttcatttgtttctgcccctgtgccgcttcctgaatggtttgcggaaaggcggcgctggatcggcctgaagattcagtttggaaaagcctttcaagacccgtttttacggcacgtgtatgaagcgggaatgcaccccgggtccctgccgccgtttatcggcctgccgcttttgcacatggctgcctgtaaacagcatccggtcgagtggcaattctatatatggctggatgcccttttcgcattgcggacaaaagcagcggtttcactggacgaactgctgcggctgtttaccgtgaggatggaaaaaaaggaaattgcattcagaaagtcaccgtatgtacgcgaaaggaacgcggcgaaagcgatgatttatgagtatgcgcagctgctcgttcaattagggctctggtcaaaaggaaaagcaggctactatatgaataaaaatgtttttgcgccaaaaaatacagaagaacttgaacatatggagcgccatctgtcttccgtgctcggggccggtgtttcaaccgggaaagcggaacagtagcgggatcaggggagttacgctaaaatgaaaaaagaaggaattttttgtgaagaatggaggaaaattgatggaaaatgggaaaaaagtacacgcgttgccaagccgggacgaggttcgtgaagcattaacctggaggcttgaggatatttttccaagcgacgatgactggaataaagaataccaaacagtaaaagaaaagctggccgatgccgcttcttatcaggggaaacttggcgaaagcgcggaacagctttatcatgcgctaaagttccaggatgaagtgacagaaaggttcggcaagctgtatacttacgcgcatatgcgttatgaccaggacacaacgaatgccttttaccaggggatagacagcaaagcaaaaagccttgctgcccaggttgggagcgcgtttgcgtttgtggtgccggaaattctttcgattgaagaagcgaaactgaaccaattcctggaagcttatgagccgctgcaattgtaccggcacgcattggaagaaatcaatgagatgcgcccgcatattttatcgaaggaagaagaagcattgctcgcacaggtttcagaagtgctgaatacttccagcaccactttcggcatgctgaacaatgccgaccttgagttcccgaccgtgatcgatgaaaacggcaatgaagtgcagatcacgcacggccgttttacacgcctgctggaaagcaaagaccgccgcgtgcgcaaagaggcattccagaaattgtatgcaacctacaaaaaattctccaacacgtttgcgagcacgctcagcggccaggtgaaaaagaacaatgttgttgcgcaaatccgccattaccattcggcgcgtgaagctgccctttcggcaaaccacattcctgaaaaagtgtacgaccagcttgtggaaacggtgaacaagcatcttggtttgctgcatcggtatgttgcactgcgcaaaaaagcgctgcagcttgatgaagtgcatatgtatgatttgtatacgccgcttgtccaggacgccgatatggaagtaacatatgaaaaagcgaaagagattgtgcttgacggcctccatccgctcggcgaggaataccggagcattttgcaacaggcgtttgaaaaccgctggattgatgtggtggaaaataagggaaaacggagcggggcctattcttcgggcgcttacgggaccaatccgtacattttgctgaactggcaggacaatattgacaatgtgttcaccctcgcgcatgagctcggccacagcgtccacagctattacacgcggaagaaccagccatatccgtacggggattattctatttttgtggcggaagtggcttccacgtgcaatgaggcactattgaatgactatctgttaaaaacgatcaaagacgagaaacagcggatttatttattgaatcattatctggaaggtttccgcgggacggttttccgccagacgatgtttgctgaatttgagcatctgatccatcaaaaagcgcaacatggcgaagcgttgacggcggaacttttaacagatgagtattataagctgaaccaaaaatactatggtacggataccgccattgatcaggaaatcgggctagagtgggcacgcattccgcatttttattacgattattatgtatatcagtatgcgaccggcttcagcgccgcgaccgcgttaagcaaacaaatcctcgaagaaggggaaccggctgtcaaacgctatatcggctatttgagcgccggcagctcggaatatccgattgaagtattgaaaaaagcaggcgtcgatatgacgtcaccccaaccggtcgaagatgcgttaaaagtttttgaagaaaaattaacggaaatggaaaacttgctcggataaagaaacaacggcggaatttttccgccgctcaatttgtatgggacactttttgtagataagggagcaggcagcaagcgttgttttttaacccgcttgttacaagtggcgcctgttaaaccctttaaaacggttgcggcggtttacatgcaaaagcagcgcgaagatggccgcgaacaaaagcgtggacgtgagaaaaagagggagaagcttcatcaggccgagcagattcaggcagaataaagcgcagaaaccggcggcaagtgcgataagtttacattttttcatatccaccaggctcctttcatcaggtttacacagtcccggtcttccgttatttacacagcttcagtgctattttatgaacaggctgacgcggtatgcaaaatttaaatttgacagatgtgtgaactctttaacaagtacttgcataccggatagggggatgttattatatagatgtgaagttgatcacaagcaaacatacccctttgtttgaccgtgaaaaatttctcccatcccctttgttcgtgttgaaagaggccttgcaaacgcaaggcctctttcttttttagggtttggcaaggatgtttggaaaaaataaatgcaagcattttatgggaaatccaggacgcgaaagtcgattcaacacatggagaagacaaacgtacgcattttcgtaaatcaaactcaaaatcggattcgctcagcaagcctaaaatataaaaatcccctgccatagacaagggtcagttgatatatttccagaatgagccgtgctttccttcgattttccgaaccttttgctgaagaacgagctttttcaattctttttcggcttcatggaccggcagatcgtataccaccgcaatttcctttgatgccacaaacccgaaatacttcagaaattcctccaatggggggagcggcaatggtgaaggctctttgcccagcatctcctgaagaacttgtacataaatatcataagaatagagtccggaaatttttaatccttcatcttcaatatgttcattaaagaaaacaagcgacgggctttcggttacttccatttccgacgtaattttcaaatcgcactgaaaagccttcgctgcgctttcggaatggatgtcatgcaaaaattcgtcgacatcgatggaagcgccttttgcacaatccactaaaatttggatatccgatatatttcgtttttcaagaaagacgagctcctgtactttccgcaaaaaccgcaatccctgtttctttccctgcagttcggccgcttttatcgcaatcgacacgatataaggcgacgtaatcgggttttcaatccataaactgccgtcgcaggacatgccggtgcggctcgccgttttttcccagtaatccgcaatcgcttcccgttttttcggaatgtcgttcagattggataattttccgatcagcacatggcggaggcggaaatagacgccatactcgagacgcagcttttttaaaaccggttccagcgcccagcattccgggcaaagcggatcgataaaaacgtagatttccagcggcttttttgaaaaacagctggaatgtttcattaaatcaatcatgtttttcaatttgcgtcacctggcacatcatccggagtattgaccatatgctgtgcggtcaggacaagcctttgaaaaaagaagtcgcggaattcgccgtcaatccctgtttcgtccattgcggcactcatgcaggacagccatgctttggcgcgtttaggcgtaacttcatgtggcaggtgccgcgccctgagcatcggatgcccgtgctcttccgtgtacagcgggggaccgcccaaaaactgcgttaaaaactgcttctgcttcctggcaacttccgttaaatcatcaggaaaaatcgggattaaatccggatgtttggcgacccgcttgtaaaacgcatcaacaagccggccaagtttttctcccccaatgatctcatatggcacagttttcttttccaccatagaataactgctcctttatctcgtttttatcttgcgtatatttaaaatcgacgaaaaggtttgctcattaaaatttttgtcgacatatctgccgtttgttctttattttatcaagggggccgcaataactcaaacaatccgctttatttggcaaactttcacagcttcctatgacctggagcaataggtgtcataatatttattttggaaaacctgcgcgatcgacctgatgaaagacaattcattgggatgtaaacgtggtaatgatatttatcggggcggggaaggacaaaatgtatgcgtgtgaccggggaaatgtccttcattgcggcgggatgaacaagaggtatgcgtgtgaggcggcgaactgtccttttgaacctgtcaaaaggacaaaacaggatgcacccgggcccgaaatgtctttttaaagccgccaaaaggacaaaacgaaagaccgcttttcaattgtttgccggaataagtgattttgctgacatttggaaaatatgccattgctgtttcctcctaatatatcattattatattacattgcccagaatccgtttaaatgttcaattttccgcctgatgttttaattctaaatctcgttgcatttttacttcgattttatccactttatagaaaaccaacgctaaagcggataagccgaaaccaataattggaacccaaacataatttgcttcaatagcccttaaagcagctgaagattgcgctgcatttgcaatgtatccgccggcgcttaagatggctccagtaattgcaccaccaagtcccattccaagttttgcgctaaaactggagaaggacgtcacaatgccctctgcccggactccatttttccattcaccatagtcaacggagtctgccagcatgacagcaattaaacctgaaacataaccggtgcccagataaccaacaatggttgcaataataatggtggtgatgcttaacgtatgagccccgactcccagaatgagctgccccagaattgccagaatcattcccattagcatcgtattccgttttccaatctttttagccgttgcaggcgttgcaacaacagcaaccaaagcgatcacttgcagacctaaaataagggaagcaagacctgcatgatgcatgttgtatttgaaaaagtagaccgtcacttgtgatttggtttgcatgcccaaccaataaataaagttaataaaaatgataatcgcccatggccaattttttttgagggctttgaccgcttctttgatcgggatggatttttttgattgcttcgtttgtatccgttctcgcgtatttttaaatgttatcatgaaaatggcaacaacaatgatcgcgatgatgagtgaagtaagaaaaaaaccttgtttctcatttccatgccctaatgcattcaccatcggcaaagttaaaacagaaaccagcgttgcccctgcagtcccaagaaattgacggattgtacttaatgttacccgttcattcggattgttggtcaggctgggaagaatagacgtgattggaatatttacagccgaatacaaaatatctacacctatataggtgatgtaagcccatacaattttactcgtcaagctcatggatggggtggaaaacaccagtacacaaaatacagcaaaaggaatggaaaaccacagaaaatacggtctgctcttcccccattttgtgtgggtgtgatcaatcatgataccccagaaaggcccatcaaacgcatccacaatacgcgcaaccaagaacaaggtaccaacaattgctgcactaatcccaaagacatccgtgtagaaatacatcaaataagtgccaaccatctggaacgaaaggttgcaggcgaaatcactcaatccataactcactctttctttccaaggaaccaaattcggcatcttcagcttttccgttctgccatccaaactttcttttgtttgagcatccatgttttcccattctccttttaaataaattgaatgcacggcatcatttgcgtgagacattttaaaagaatagatggccggccggataaataaacccagccggacttttctatttatgaagaacggcttcttcatgatggaatctattttgaatgactgctgcatctccatgttgagggtgccaaacgacttgatagttttcagggccttttactgttaaatagaccgtaccgctcttattttccgctttaaccgtaaccgattcgcgaccatccggctcataaacaacggtttccttaattacatcctcgccgtcaaaaccgtagagatgaataatcggttcttttccgtattcgtattctgcatgcgctgtttccggtccacagataatgatgctgttttccttggccagcaatggaaatgccatataatcatagttttcatggtaccattttccgccttcataaactttcccggttaaaatgtttgtccactttccttgaggcaaatagtactcggcatttccatcctcattaaaaatgggggcaaccaatagattttctccgagcatatattgcctgtcaagcaaaactgcagccgggtcatcctgaaattccattaccatcgggcgcatcacaggaacgccaaaccggtgtgcttctaccgcatgtttaaagagatacggcattaaactgtatttcagttttgtaaatttcttggtgacctctaccgcttcctcgtcgaatatccacggaacccggtactccacatttccgtgataacgactgtgtgaggaaagcaacccaaactgggtccaccgtttataaatatccggtgtagccccttcttcaaagccgccgatgtcatggctccagaaactgaatccagataacattaacgacaacccaccacgtaatgattcggccatagaattataatttgattggcagtcgccgccccaatgcactggaaactgctggctgccggcagtcgcagaacgtgcaaaaacgaccgcgttttgttcgcctttcttttcttttaacaggtcaaataccgttttattataaagataagtataataattgtgcattttgcctgggttggaaccatcataataaactacgtcttccgggattctttccccgaaatctgtcttaaaggcatccactcccatgtccagtaggcgctcaagttttgaagtgtaccatttgcgtgcatcaggatttgtaaaatcaacgactccctggccgccctgccatagatcccattgccatacactgccgtctttccgtttaatgaaataacctgctttttttgcttcctcaaataacggcgacttttgcccgatatacgggttgatccatacacaaattttcaatcctttatcttttaagcgctgtaacattttttccggttcaggaaaaatacgcttatcccattcaaaattacaccattcaaattctttcatccagaaacaatcaaagtgaaaaacatcaagcggtattccccgctcatgcatcccgtcaataaattgattaaccgttttttcatcgtaatccgtacaaaaagaggtgctaagccaaaggccaaatgaccaagccggtggaagcgcaggttttcccgtcagatctgtgtacttccggatgatttcatgcattgtcggaccgtaaatgaagaagtattccaatgtttcatcttccacactgaactgcgttttcgatacatgttcggaaccgatttcaaaagaaacatggccaggataattgacaaaaaccccatatcctttattgctaataaagaatggaacatttttatacgactgttcactgcttgtcccgccatctttattccatatttcaactgtttgcccatttttcgcaaagtttgtaaaccgctcgcctaaaccgtaaatgtattctcctacattcaaatcaagactttctttgatataagcctttttttgatcggataagacgtaacctgttgatttataagctgattttgtcagcaggcggtctcctgcaacaaaggaaagttcatattttcccttattaattttggctgatagctgcccggtcgtaacggtaatcaagtgttcatcttctgtaacctgtatcttcttttcctgacgatgaacttgaaattcaggccctttttgtattccaccagcatggtgagtcagcttcacacttaacacatcttcttgtggagaagtaatatcgactgtcatcattccaaggtttaatgtgtcagctcttgactggactttcttaaaaggtgcaaaaaccgtaagcttcttttcatctgtttgcgcctcaaaaacatggattggggatgagatcgtatatccttctcttgccaaccaaacgccatttgtaaatttcatcggatgtccctccaaatttgcttaacagcctcagaaaatacttaaatctttcaaaccaactagttagtttgtttagctaacaaactcataataattccgttcaacaaaattgtcaacgttttcacgaaaaattttaaacaattttttcctttcacaaatagacatgaattggtaaaatggagattcaagggtaattccttgaacaattaggcacaataaaaaagagaggcttgaaaatgtttctaaacaggccaacgatgcgcgaacaaaatgaaaacttaatcattgaatatattgccaaccataaaccttcttcaaggatggagatttctgacaaaatcggattaaacaaagcttctgtttcggaaattgttaaaaatttgttaaaccggcatttcattgaggaaattggcagcggagaaagtaccgtgcaaggcggaaggcggccgattatgctgcagttaaataaaaaagccggattcgtcctcagtattgatcttggctataactatatcgatatattgggatgttatttgaatggggagagctgggagagaaaactttacccgtttcgggacatctcaaggagcagcattgtatccgatcttaagttaatcataacggatttcatgaaacatgcgccggaaacggtctatggtttaacggggattaccgttgccattcacggcatggtgtttgaaaacgctatttattttacaccctattatgacctgcaggatctcccgattgctgaagccctgtcggagcattttgacgtaccggtttttttggaaaatgaagcgaatcttcttgcacttgcagatcatgcctgtacggatactttgcataatataatcagcgtaagtgtccacagcggtgtgggtgcaggtattatactagatgaccaattgtatagaggggaaaaaggactaagcggtgaaattgggcacatggttgtggtcccaaacggcttgagctgtccttgtggaaatcacggatgcttggaacaatattgttcggagaaagtacttctagatcactaccgccaccgtacaggcaatgcagaagcgattattccggacatatgccatgcttaccataacggggaacagcctgctgtccaactaatccatgaaatgattcaatatatggcaattgccatgaataatattgcaatgctgtataaccctgaaaccatctttattaacagtgaagtctcaaggctcatcccttcattcgctgataaaatacaacaacaactcagctccttcatcgcggacaaagtaaaagtgaggcagtccatacttggggaaaaagcaatactattcggtggcgcagcacttgcaaccatgaacttcttaaacattagccgaatgcgactagagccttaagatttacagtaaaaaacaaaggagcagcccagtaagccagataaccggatgagggctgctcgtttccttatatatcctgcaaatccacaagattttcggtgtgataaataattatctactagttgttgttaaaccacttgttctttcatatatttcctttatctgttgaaaccaccccgctatttcttcgtaaacaccatgttcttttaataaatctgcagttattttctttgtcaaacacccatttaatatttgcttaattcttttctctttttccctcatatttgttatatgaggtagggtacacttttttaggtgttcaggaatatcaaattcattccacatataaagatattcgtctaagttaacaccaaattgttcttcaattaagcgaggaggaatgtaattttccatttctctaagagacgtaacgacaccaaaccttctcccatcatttttttcgttcattgtgtttactatatctctgtatttaggtatatccccatcgtataaatgaaattcgaagatattagattttctgaaatgatcttcatttacccatgcttttaaattactaccccctagatagtaaatactaatgtccgcattttccaaatcaattatttctttaaattctggaacaaatttgttaatattttttataaagttcacatcattcggtccttctacgcagattacaacccttgaatgaatagaaggaagaatgcctagtgtttttgttatctgttgcattttaatgtcctcattcttaactacttgcggatgtccttcaatatccttctgtaataaaatgagtgaatctttttcgaccatttgtgctatctccggagtatgtgttgtaataaagacttgatattgttctttttctgagattgtttttaatgaatcaatgatcattctttgatagtttggatgttgagatgtttctggttcctcaatcgcataaatgatgtttcttctgttatttctaatcgcatctttttctgcttgtgcacgaaaatagcttaataatattaaccttcgaactccacttcctcttttatttagaggcactccatcatcggtatctaggttaaacttaaacaagctgtcccaactttttatctctggtacagtaattaattgatttgctatttcctcattaaactccttcagtttctcaattgtctcttctccaatcttttcaaccttactaacaacttcatttttaatttcttctaacttgtctttaagatctgctaatacttcttttgttattgccttcataggatcctgaacttctttatctccatccgtatttgttcgatctgattggaataacgtatagtatggtaactgatcccgaagcttgtcccaagttttcaagctatcatcttgtatatcttttatatttatttgtttttcttcaaatcttgtttgttcacttattaagtgtgaaaataaagctattctcatatccgctttttttgatttgctaatactatcgaaattttctatctcaagtttatattggttcagaagttgctttagctcactttgtttatatgtaataagaggtttttcaaataatgttggttgaaaagtatttaaatagacagaaatactacttttcgttatggtttttccacttgcgttaatcacttttctaatttccaatagatcttctctatttaacaaatgttcttctttcaacgaggttgggtttgttgcatctaatattaccaactcgttgtcttccagacgaaaacaagccccaatttcaatgaatttatcttccgagtgaatattgcaatcacttgtatcaattttagcgtcatcattgaaaaatatattcaatgcatccaatattgtacttttgccaacatcattttcagctattaatacattcaaatccggatgcagttctatagttgtattattataccctcggaagttcttaagaattacctttaccagcttcattttatgaactcctttcgattttctaagcgacaatatatagtcatcttaaaatgacattccataaaaattttgggtaaatttctaacaaaaatagaggactccttatcaccaaggtctaatatattttttcgtcgtttaccatatccatatcgcaataaattgttgatagtatatttcagcaattatcgctttttttaccatagccatggtgaaaaaagcccagggatcatcaggtgtttccaaagtaatgttttgaactgaatgtactattatacaaatcttttctttatcgagattgggtatctagttacatacaaattcattgtatacgctttaattttccaagtttatattttaacaaatcttgacgaaatcggaaggtttacaattgttatcagacaagagtatttcatgaccagataaaaaataagcccaagcatttccatgttttaaaatcataagatatagcctcttgcggtactgtgtcctgaattcagtgagcgtaagccgattatcattctgacaagtactctcccatttatacttcagcatatctccagctggatccggcccccaacaatccctcaatcccggctaaacaaatccctcgtatacaccttctcctccacatcaagcagatcatctgataaccggtttgccactatgacatcgctgacctttttgaattcttccaagtcattgactacccttgaattaaagaacttctcttcatgcaggacgggttcgtatacgaccacttcaatgccttttgctttgattcgtttcatgacgccttggatggcggattctcggaagttgtcggagtcagttttcatagtgaggcggtaaatgccgacgactttcgggtgtttcttgataatcatttcggcaatgtggtcttttcttgttctgttcgcatcgacgatggcttgcatgatgttgttcggaacgttctcgtaattagcgagtagttgttttgtgtctttaggaagacagtagccgccgtagccaaacgatgggttattgtaatggctgccgatcctcggatcaaggccgactccttctatgatttgtttcgtgcttaatcccctaacttccgcatatgagtctaactcattgaaaaacgcaacccgcatggcaagataagtgttggcaaatagtttaatagcttctgcttctgttaaatttgtgtacaatacagggatgtcttctttaattgcaccttaagccaataagcccgcaaaaaccttggcccgttctgattgctctcccactataattctcgaaggatataagttatcatacaaagccttgccttcacgtaagaattcaggagaaaagatcacattgtctgtctcaaacttttcttttatcatttcagtatatccaaccggtacagtcgatttaatcaccataatggcatttggattaattgaaagcacattggcgattacagcttccactgttctcgtgttgaaataatttttctcaggatcatagtttgtcggggtagaaatgatgacatactcagcatccttataagcaagatagttatcagttatcgccgctaaatttaaatcttttgttgcaagatactcttcgatttcatggtccacaataggcgaccgcttgttattgatcatatccactttttcctgaagaatatcaagcgcaatgacttcattatgttgcgccaaaagtactgcatttgataaacccacatagcctgttcctgcaactgtaatttttgtcaatgaaaacatctcctaaagttgttcagataggcgacaacatacctgtttccgctttcattttttaaaaaacatgcgtatcattgttttctcttttattttatcaacccttcccgctattttccgaaaaaaatttgacaaattatagaataaatgcagaaaaaaagagcaccctgatttgaggtgctccgttttaatttcacgcctgaacttcatcgagtacgctgaattcaacgacactcgggcggccaattgaatggtaattaatccctttattttcaatttcacacagactaaagcagttccggccatcatagatatgcggagtcttcatctgtttcttaaacaaatccagatccatttctttgatttccggccattcagtaaagataaagcaaagatcagcatcttccaaagcctcttcaatagagtgtttataagcaatctgatcaggaaacagtttcttatagttttctatcccaaccggatcgaatgcctgtatacgcgccccttcatttagcagcaagcggatgttcggaatggacggtgcttcacgtaaatcatccgttccgggtttaaaggtgagccccaataccgcaacctttttttcgttaaaagttggaaaatcattgcgtgcttttttgatgagtgcatatttttgtttttcattcacatcaatggctgctttcacggttcttaaaatatatccttcttcttccgcaagccagtgtaacgcttttgtatctttcgggaagcaagagccaccgtaaccaatccccggatttaaaaatcggttgccaattctttcatcgtagctcatcccatttgtgacatcttcaatgttcgcaccaaccttttcacataggtttgcaatatcattgacaaaggaaattttcaaagccaagaagtcattcgaagcatattttaccatctctgcgcttcggcgattcattgccacaatcggttgtttaaaaggttcgtagatacttgttagaatttgttttgcattttcactttcgacgcctattacaattctagaggcatgtaaagtatcccgaactgcagtaccctgggcaaggaattcaggatttgaagctacttcaatctgaacattgtttataagatgctctttcataaaagcttctattttatcatttgttccaattggaacagtggacttaataacaactaggcaatccctttctacagattcagcgatctgctgtgcaactgtataaacatagtttaaatttgcagagccgtctgcattttcaggtgttccaactcctataaaaataacatccgattgggcatatgtttttttataatcggttgtaaataatagctttccttcttttttattctttaccatcaattcatctagtccaggttcaaaaataggagatttaccactattcaataaatctattttatcctgattgttatctacacaagaaacatggtgaccaacctctgctaggcaaacccctgtaactagtcctacataacctgtgcccgcaactgttatgtgcttcattttaaacatctcctaaatattttttagaattattttatactataacaatagtcctcaatttcatcccaatccataaatatacgaacaatatcttcttctaatatctctgttcccgactgaacctcgatcatttcaagctcagtagtggcttttattgcatgtttgtctccaatttcaacttgtaaaacatcgcctgcttttactacctgtaaactaccatttaatgcaacaacgccttcaccttttacgaccgtccaagtctccttacgtgctaaatgatattgataacttaaattggatccagccttaattcctattttttttgttaagacttcttgagtaccattatacttaacatgatccagcacacggtaccacccccaacgacgctcttcatacatcggtcgatcattaaacgtactgacaagctctttaattttgggacttttttctttatctgaaacaagaataccgtcaggacttacagcaataacagcattcgaaacgcctaagatagttactggaatatcaatttcattgattaaatgagtattgatactatcttcactgataataccatttcctatcttattagttcccatttcctctgttaaagtattccatgttcccaaatctttccaatatccattatattgtaatgcaataatatttttagctttttctactacttcataatcaaaactaatttttggtaatcttgcatattgttttaatagctcttcgtaatggattggcaaatgtttttcttcaagtaaattaataagatatcctaaacgaaaagcaaatacaccacagttccacattgcaccttgtttcaataactctctagctctattttcattaggcttttctgtaaaacggctaactttgataacttgagaagaatcaatcgaatcgtcttcaggtacaatgtatccatatttctctgatggataagttggcttaacacctattaatgccaaatcagattcacttttctgaatagccatttctaaatccttgaccctatcaaaaaaacttgtttcgacataagggtcgactggaaggactccaactacttcatccaagcgtgctcctgtatttgtatacaaatatgataccgctaaggcaatagcagggaatgtatctcttcttgtcggttctactattagatctgcttctccattcaattgactttggatcatttccacttgagatttacttgtcgcaataactgttgaattattcaaccgcgtttgtttcaactgactccatactcgttgaaccattgattctaaattatgatttttattttccaagacctttaaaaattgttttgatcgagcatcatttgatagtggccaaaggcgtttcccggatcctcctgaaagtaaaattattttcatttttatcatccttaaaatataataaattacaaattaaactttatagctaaaatagctttttaaccaaactactaaactgctcaccataacgaacttcctttaatcttttaaccttttttatattttcttttaaatctaatctactattataagcatattctaaggccttcattatagatttccaatcattttttgtatatagagcaccattcttgtatatttctcttaaagctttagtgtcggataataccatcaccttttcagccccaaggccttcattactaacactcatctgaatatcattgtaaatggttaaacctaataatatatcacattcaaataataatttaatatattcatcattttcaatccatcctgttataacaacattttctggtaaatcttctggtaatacattaaaatttctttttaatttcttctgattgcccgtcataataaactgaaagtgcgggagattttttgcacattttattacatctagaattggctcatccatattaaaagaagctgggaaaaatattaggggttttgaatttattccatgtttatctatataagtagtatttttttgaaaataaggagttttatcttctaaaacgataattttattatgatctacttttttaaatagcttattatttattacattgtcgtatacaactttattgtgaactactataatatcacaataagataataatttttgtgtacctaatctacttaaccacggatttcttgtcatggcattatgtaaatcacatactacttttacttttttattaaatttttttactaacaaaggtacaattaatgcataactaggtggtgtttgtacaaaaataatcttcggtaattcttgcttaatttttttataatcctttatcatgtatcttaaatagaagaaaaatttttttattggttttgccgggggattatttctatatataatttcaaaatcccctaaatttttttttagatccactagtaggttttcaactcttgcttgatatttcgtccatactataaaaacgtttttcattaatccatcctcaaatctattaaatatttaaaacatgtgaaacaatatactttgctagttgacctctagattcgtatttaacataatctttattccttaataattgaataatactgcccaattcattaatattttcaaccttctcaatgtaacctttctcataaagaacttgaactatttctatctgatgatcatctacatgctctttaaatttagacatacgtggtacagcaataactttttttgaagcttttaaggccttaatgattgaagatgttccaccgtggcatattacaaattcagctttgtttagtaattcatcaaataaagcttcatctatcaacttataatttgtagcatattttgatttcctactatagccgtactgtaaaactacttcactagctttcaatttcttattttctattaagaagtctatttcatccacaactctatccatttgaaatctttgagtacccaatgtgattaatatcaatataaactccccttataataagcttttggataaaattttagcatatctggccattgtacaaaaaattcatctgcaaacttataaactatcttaccagtcatagtaggactattaattttagcatagctctcaataaaaattatttttgctccaaatatcttagaaaatacaagataaggaattacaacacctgcgccagttgatataacatagttcggtctgaattttattacataataaagagactttataatatttaaaataaaaattgctagaaaatacttgttctttctatcttgttgatgtaaaaataataaattatcatttagtatatttgatttatttttctctgtaacaatctgcagttcagttttagtattttgtaactcattaaataatattgaaagctgagtccaatgtccccctgttgaactaattagtgcaatttttctcatcttctcctccaatttttaccgtttgttaatctgaatcttcaaaatggcatttcaatcgaacataattaataaaacatagatttgctagtataaatggtatactaaaatgtacagttacaaacaagttatcatagtacgaaactatactaattgaaataattgtacaaattacaaatatattacttataacattctttttaaaggactgctttagaatccatttaatataaacaagaaagaaaataaacataattattaatcctaccacccctacctctaaaaacgatcttatatactcgttatgcggagccacaaattcttgataaggattatatggatataatgactcacttgcacccattcctcttccaaaaaaacgatgttcatttgctttctccataaagtatttccacgctgcagctctaccggaagtattaaatcctcctgagttatttgtagatctttttattaatagctgtataaatattttaagacaaaataaaagtggaattattccaagtgaaagtattgatactaataaatatgaaaaattatcctttaaaaaggcataatataattttcgaattaagaaaaaaataaaaataataataactcccaatatttctattctggtaaatgttaataaaataattagagaattaataaaaagaaatatatatagctttgcccttttccctctatcaagaataactttattaatatgataaaaatctaatattgccagtgatgttataatagcaacaaaacatatttctgctaaatgagcaggtggattacttccttgtaaacgtggcacaccagtaaattcaaatttaataaaactccaactagttgtaattgaaaatataagacccacaattacactaatactaggcattacttggataattttcagaatattcagcaattcctctttttttagtcttactaacattgataataacaaaagaagatatgcagagtaagatcttaaaatatcgccagtatttgcatattcaacactatctttccttgctatttgtaggattaggaatagagtcaaaacacacataccgaatatactatatatcattatgaaatttacttttattcctctaattaatattaggataattgtaatgactaaaagacaagcttttacactggtaagtactaatcccccatgctcaggtattaatggtttccatgaaatagcacctactaaaataataaaaatataatataaataaatcatctttagccgcctttaaacaaaataaattaattcaatggaaatatttcttaaaattcggattatatgctaaatttctttttctctcacctatcttcttagccggaattccaccaactattgtataaggatcaacattttttgtaactacggctcctgctgctacaactgccccctctcctattttaactcccggcataaccatagcatttgtacttatccaaacatactcctctataataacttctccttctacatacttaaaatcaggactatttaagtcatgctcagcagtatatatttttacatatggtgatatatttacattatcattaattacaagcccacctcttccatctaagactacattatcattaatagcacagtgattccctattgtaatattaaaaggattatagaaaaaaatgggacgtaggaaagtacattttacaccaattttcatacctaatgacttatacaaaaaaacacgtataaattgattaggtatatgcggtattaaaaaattgaacaccgccaaataaaaatctttgaatagcttcataaattttcattcctattctgtcttttagtaatcttaaatctcactatacaaataatactaattgccattaatgcatctgaaaatatgctaactataattgctccatatactttatagtaacttataagtataaaatttaatattgtattaatagccgcaattgttaattgtactatacttctttccttttgaagcccagctcctgtaagagaatcagatagaacgtaatgcacgcatcttaaaaagacaataattaaaaggatattaaaataatatagactctcctcgtactccccattattaaatcgagctaatattgtaggagctaataataatgaggcaatactagcaataatacaatatataattaaaggaaaaagtattctttttgcaaatttatatgtaccttttattccttcgtttttaccaattttgaagaactttggaaatgtcaatgatagtattgctttaatcggaataaatattacatccaacattttatacgcaaatccataataaccagtctgctggaaactatcgtatttacctaatattgttttatctatatcgttataaattccttgagaagataaacctatagaaaagaaaatcccttctttaatattgttaaaggtaattttgctattcatattaggtaaatcattttttgttagcgtataaatgaataccaatattgtatatagtaaagaaattagcaaatatagcattgaccatattaatatatcatttgaactattatcatgaagaaaataaaagatcacaacagacataaatcgggtcaaacttataaaattctgtatattagctgaaacatttaccctatttttagcaataaatatctgagcagacatttcatttaattttaagaataacaaatccgctagacttaaaattagaaatagcatatttactaatatctgattcctatacaataaaaatattattaattctccaactaacaaaagtataaagtaactgtatatggttattttaattgtatttccaaaaacatttctgaactctttaacatcagtagcaataattttaacaattaaactattaaatcctacaccacaaaagggtcctaagataacgataagcgaagttattgccacatatatgccatactgctttggattcataataatagccaacaaaaagaaatatgcagtttgaaaaatcaaccgtccaccctggccataaattatccatgctacgttatagaattttgatctcatttaataactccaatatctattaataattaatctcttaataagcactattaggagaaataattattttgaaagttttaaagataattattaagtcaaataaaaatgacctctctctaatataatacaaatccagttcaaccatttgactaaagtttaaactatttctaccactaacttgccataaccctgtacatcctggggtaacgagtagacgttgtaagtcatattcagtatactccttaacttctcttggcaagggtggtctaggaccaacaagactcatatcgcccattaatacgttccaaagctgtggcaattcatcaatacttgtttttctaataaatctaccaatttttgtaacacgaggatcctctttcattttaaacattgcaccagaaacttcgttaagttcaagcagatcctttaacttttcttctgcattcatcaccattgaacgaaatttatacatatagaactcttttccattctttccagtccgtacttgcttaaaaaaaactggtccctttggatcctctagttttattagaacagccacaatcaaaaatagccaagaaaaacatactaatcctaatattgacccaataatatctgttgttctttttgctaataaataagactttttttcttttaaaacaaggacctgaggattttgtctaacaactgacttagacaaaaagcttgattccgacaattctatctcccctatttagattctgtttttaaactttttaaaagttcatccataaaattgataactgattgatctatggatggatcttgtaatgcaaactcaatagttgtttgaataaatcctaatttttctccaacatcatatctttttccctcaaattgataagcaaacacacgctgaatttgattcaattgttgaattgcatctgttaattgtatttctccgcctgcgcctttttcttgtttatcaaggaacataaaaatttctggagtaagtaagtaccgtccaataatcgcaagattggatggtgctgtccccggcgctggtttttccacgaatgtttctacttgatatcttctaccttcttgagaagcgggagcaattacaccataacgatgtgtttcattttccggtacttcttgtacccctattacagatgaacgtgtttcttcatattgatcaatgagttgttttaagcatggcgggtcgttttggacgatgtcatcgccaagaagaactgcaaatggttcgtcaccgataaagttacgtgcacaccaaacggcatgccctaaaccgagtggttctttctgtcggatatagtggatattggccaaatttgaagaatagcggactttatctaagaggtcgaattttcctttttcagcaaggttctgttcgagttcccaggcgttgtcgaaatggtcttcgatcgcgcgttttccttttccggttacaatgatgatgtcttcgatgccggattcaacggcttcttcgactatgtattggatcgtaggcttgtccacaattggtaacatttctttcggcatcgcttttgttgcaggcaaaaaccgtgttccgaggccggctgccgggatgatcgcctttctcacttttttcacgtaaattcccccttattttaatttatttttaagatttgcgcagtacgataaaaacaatcgatgtttgttcttccagcattcgggtataaaagtaaatgtcgggcatctaacccgccctcacaccatactcttgacgacaggcgtctaaggtgcacacacacccacagcatggccgagtgcctcgcacgataacgggtgagagacatccccgaaatagctgttccaaaatcaagcaacattggataaaactgtttgctaaaaacagcggagcagccccatagttccattcatatacccttgatgcttttcccaaaatacttaaaaagaaagtcagttaaaacaaaccaaacagtttcttttgtcttactggctgcggaatttctctgtatatggattggccgcctgcaagcagttcggcgttctctgtaaagaaatagagcatatctgcaccgtatttcttttcgatttcgtccgctgcttcatccattttaaaagcacgtgtttttacattatgggcgtctgatgcaagaaaatgggtgagattcgcttctatcagctgttcggtgaattttttaatctttttcccgaaagcacccgttaagcttgcggctgtaatttgtgttgccacaccattattcaccatttcatacaaccgatccggatgctgaatcagctccgcgttcctttccggatgcacgataatcggcaccaggcccttcacttgtatctcgtataaaagggtttccgcatagcgcggcacatgccctgatggaaactcgataaagaggtaagaagtgccggccagcgtttgaatttctcctttttcatagtcttccaaaatttcgccataaatccggttttcctgtcctggcagaatctccagatcaatctgttcttctttcaatcttttatttaactcatttactttttgaatgattccagttttgcggttttcatattttccattcatatgatgaggggtagcaataatctgcttgatcccctgggagacggcttgttttgccatatcaaggctgtcgtatatcgtttgcgcaccgtcgtcaatgcctggtaaaatatggcaatgaatatccatcatcccgaacccctccaaacctgtcaagaagtgaaattttgtttcaattagaatcaaaccctatacaaaattatagtgcatttttaccatttttcaatagttattggaaaacttacgtgcaaatagtgtcaatcttttccgtaatagtaataataatgcgtgttttgggttttcttgttgttcaggacaacgccaagcagattggcattggcagattccagcaattcttttgcctttttgacagcttccacttccgctttcccgcttgagacgacaagaatcgtgccatcacactggttggtcagcacctgcgcatcggtcacagccaaaaccggcggggtatccagtaaaataatgtcgtactgttcttttgcttcttttaaaaattccttcattgcccgtgagcttaacagttctgccgggtttggcggaattgggccgctcggcaggagatgcagattttccacatcacattttgaaacagtctccagcaatgtcccctgcttggtcaaaaccgttgtcagcccaaacgtattggtcatgccgaacgtataatgaacggtcgggcgacgcaaatcggcgtcaacaaggaggacccttttcccctgctgggcaaagacgactgccaggttgccgacaatcgtcgattttccttctccaggcccgcttgaggtaaccattagaagctgcaggtcattgtcaacggaagaaaaactgatatttgtacggattgtccggaactgttcggaaatcggtgacattggatttagctttgcgattaattttcttctcgtgttcaacagctttgtttttttaggcgccaaccgtctcaacctttctttttgttttttttcctgcgcggttcaaaccattcagttcttgatcgtcaatctgcccaatcacgccaaggacaggcaattccaacatttgttcaatatcctgctcatctttaatcgtgttgtcgaggtattcaagcagaaaggcaatcccaacacccaccatcaggccgacaacaagtgcaatcgcaatattcaggaatggtttcgggctaacaggtcccgtaggcacttgtgctttcgaaataacagtcacattgtcgactttcataatgtttttgacttcttttttgaacactcccccgattttattggcaatttttgcagccatatacgggtttgtatcttttactgtcaaggtaaagacttgtgaattttgctctgtactgacttcaattttatcgttcagttcgtctgttgtcatgttgagtttcagttcgtcaatcactttatctaagattgacgggctcttaataatcacattatatgtattgaccagctgaacgtttgtctgtacggcattcgtggtatacatcgattggtcatcgcttgctttattgacaaggatttgtgtcgaagattcatagacaggcgtcatcacaaagtaggtcacaatggccgtcacaatcatcgcccccagtgtaatcagcgcgatcatggaaagccgtttgcgcagcacctgcaccaattcttttaaactaattgtgtcttccataagttcctcccctaaaatttgcagcacaaatgcgaaatagatagaaaactatcatacattatatcatagatcatcccgaaatttgcgggaaactgaaataaatttaaacaatttgttacactttgtattaaaccacaatattttgcagaaagaaaccggttagataatcttcctgtatttacctttggcggattttctttcaattttggttgtgtaatttgtctttttttgtcataattttttataggtttgcacgggcgtttcataagtgatgatgagcggaggtatgatgtatgaaaatattcacggcgattttgtcggctgttgtcgtcattgccgtattggtagttgggcatctgtactgggggtataaaacggatccaagccggttcaagccggattctgtagcagtaaaagcggaaaaggcaaaggcagaaccggccacggggaaaaagcggtcggtaaacaaagcggaccagccggagacttccctagtggcttacacgaaaaactggccgaaaaaagcccgcgcggattttaaaacagcactttccaaggagcgggcctacaaaattgcgattgtcggttcggatgcgatgggggcgaatacgcatggctgggggccgcagttgaaacaggcattgcaagatgcgtacggcagctatgtgtcggtttccctctttgcctatcatttaaattccgacgagtttatccgtgaaggcaagtataaagacgtcgcccatttcaaaccggatctcattttgtttgagccgtttattttaatcaacaacggagctgtggcgatggacaatcagcttgatgatatcaaaacggccgctgctgcctgggatgatgccgtgctgatgattcagccgtcatacccgctctacaaggcagcgaattatccggcacaggtgaaagagcttgcgtcgtacgcaaaaaaagaaggttacacatacctggatcattggaaaaactggccggacccggacagtgacgcattcaaatcgtatgtcacctttcaaaatggcgaacaaaccgccccaagcaacaagggcacaaaagcatggtatgactacttgcgcaagtttttcatcgcagagtgaggaagcatcaacgcttcctctctttttgttccatattctttctgattttctcaagggcttgtctccgccatttttttaccgcctcgacggatttgccttcgcgaaatgcgatttcaccttgtttcaattgttcataaaaagtagccactacccattttttctctttttccgtaaggccgtcgcaatacgacagcaatgtttcaagctcaagcgggggacgaagcgactcgtccacttcaacattccaaaacccctctttcggaaatgcaaacatttcttcctccctccgccttttcgtgagttcggtcagcattttcccgcggatcgtgttgtacgcataacttgtgaatgaccctttgtcgtcctgcctgttctgatacgcttcccacagcgcaatcataccgatctgttcgaactcatcgatgtttttgtaaatgcggagtttgcggatcatatgaaaaatcatcggccggtattgcctgagcacttcttcaaaattttccactttgcttccccttttggaaagcgcgctttccttgaattcccgggttgattgtaaaataacaggttcaaaggaagagggcgaaccggcgatcgtcattttttggtttccaaaacatcctgttttccgcgggaaaatttgatattttttaaggtaaaacgtgaaattttggccaagatttacatggattaaaaataataacaaaattgtaaattcatgctttattttttagaaatttatagtataataggactataaaaatcaatgatatccctcttcttttggggaaggatactttgatggcagcaagacatggcacccctggcaattctgcccctgaaagtgaagcgggagggaaagcacaaattaacatgagggggtattttttgtgacagaaaaaattgactacctaatcaggaaagaaacgatggcgctggataccgcatttgatccggaatatcaaacagtcatttatgatcaggacggcgtttttcgctcacggaagagcaagcttgaattattacgggacgcttgcatccattaccggatgtgcgattttgaaggcgttctcaagggaacaaaacaaatttttaactttaataaggcaccgattgtggtgggggatggtttgattgcaacaccgacaaaatccccgagatcgtatgactgccagttcattttcctggcaaacataatagactttgatgccacggcggacggcctttatgttactttttccaatcagcagcagctgaaactgaactgctccgtgcatacatttcagaaacaattcagccgcacgattatttgtgccagctattaccatggcctcggcaaatacataccatggaagaaaatgatctaggggctgttttcaggtgctttgagaacgggcgtgcaatcgttgaaattgggcgttacgccgaacgcacatccactctgcaacaccatccaacttatgtacgcatgcgtttccttcattccagttttgaagctggacggagatgatgcgcatgcgctccctttccccaccgattacccacgctccacaaaatatcacagctctgttgcctgctttttgcaaatggatatcgccttgttgcaatctttttatattgaactctatctctttctcctgttgtaataggtgtatttttggttgtggcggtgcccctatttgatttggttttggccctttatttttttgcttttggacgtgataggtcaaattttgcgcaaatgatctgcgccggtcggataactagcctgtccatttatttcttttgcatttttcgtttatcggcctgtgatcagggaataggaaagatgaacaatatgaatgggaggaatgaaaatggatcaagactccacgaaggacaagctcaaaggaaaagggaacaaattgaaaggcgaagcaaaagatacgtggggtgaaatcaccggcgatgcggaaaaacaagctgaaggcaaaatggacaaattgaaaggcgaggcccaggactcggtcggtagtgcaaaagaccgcctctcccgtaagtaagccatttgcatttggtaagttgctagaaagcaatggagcttttggactttcattggctaagaacagaaaagaacgaaacggctcaatgcggattttccactcatgccgtaaaggatacggcatgagtggaagaatgaaaattagccgcagtcgccgcacatttttagatagatggatgtaaagcccggatttcggtattcgggcttttttatatgggtatttccgtggaaatattgctggttttgtcgagatgaatcgtatcttgtcatcttgtcatgccaccaaaaacgtcaatattcgcagccattgggaatgttaagttatgcaaggatgatgacagcactggccgaatttgagatgtacaggttttattcagccggcgttgatttagcgtagacgttcaatgccacagggaacgtggtaggtgaaagcatggcgttattttatatagaaagaaagcgggtcaagcatgttcgtacgtctattcttctatcatatcgaagaagggcttgctggcaagtggaatttgttcagaaaatcctgttcaacatgcacagttttcagtggaatgtttcccgtggaacattgagggcggaacagaaaaatcgggttagcgcagattttgtcgaatcatttggttttttgtaaaaagcaacatggcactggactctgaaaaagtcgtaaatggtttaaaaaaccgaagcgggccagggcccgcttcgggagttataccgcaaaatatcttgcctcaggatgggagaatacaagcgcggtgacggcggcttcgggttccatcatgtagccttcggtcaagtggaggccgattttttgcggttgcaacaatttaaacagtttggcctggtcttcgaggttcgggcaggccgggtagccgaaagagtagcgctggccctggtatttggcggcaaagcgttgctgcattgtgaaatcagccgggtccgggaagccccattggccgcgtatcagttcatgcagtcgctcggcgaaaccttctgccgtttcgagggcaagcgcctggagagcatgacttttgaaatattcgcccgcttctttcaaatagcgtgcatgatggcggatgtttttgccggcaacgaccgcgaacatgcagacgtaatctacgaccccactgtccacgctccggacataatcggcaaggcacaaatacggcggctttgcctggcgcgggaacgtaaatcgctctaggacggataaagatttcggatctaatgtaccaggctctccagccggttcgtaaagaatcaaatcattaccatccgattgggcagggaaaaattggtatacagcggatggctgaagcaatttttctttcatcacccattcgcgcagttcatccacctgctgtttcaacttgagggcgcgttcgtctccctccgcaagcagcttttcgacgcggcctttcaatcctaaatggtggccgaggagcatttgcatgttcacgtagggctcgatatgggcaagcggataattgcgcagcacatgccgcttcaaatccgccggctggtaaacgagcgcatccggggataccgaagaacggcgcggtaaagtcgcaaccggtgctccgccggcattcacggccgccacccttgtcccgccgctgcgctggttggcaagttccgtttcgagcgagcttcgttccgattcatcctgcaatttgttcgcaagcgtgaggccctccattgcgtcttttgcatacagcacaagcccttcatattgcggagcgattttatttaccgtgaatttccgcgacagggctgcaccgccgaccagtatcggctgacggatgcccgcttcccgcaaatcctgggcagtgacgaccatttgctgggcggatttgacaaggaggccggatagcccgattacatccggtttctctttacggacggcgtggataagatcagccggcgccactttgatgccaaggtcgaccactttatagccattatttgacaaaatgatgtcgaccagatttttgccgatatcatggacgtcgcctttcacggttgcgagcagcactttcccttttgtgcttgtttcatttttttccataaaaggctcaaggaatgcgacggatgctttcatcacttccgcactctgcaagacttctgcgacgatgagctggttgtcgttaaacaggcggccgacttccgccatcccgtccataagcgggccgttgataatggcgagcggatccgggtattccttcaaagcctgttcaagatccgggatgaggccttctttcgtcccttcgacaacgtaattcgcaagccgttcggcaagcgtcatcgtgcgctttggcgcttttttctcctgcaccttgccgcggtaatattcggtgaacgcggcaagggcttcgtcactcgtttcaaacaacagtttttcggccattttcacgttctcttccgggatggacgcaaagcgttcgagtttttctgtgttcacgatggcgtaatccagcccggctttcgtacagtggtagagaaacactgagtttagcacttcacgcccggcaggtggcagcccgaatgaaacattgctgacgccgaggatcgtctggcattccggcatcgcttctttgatgaggcggatgccttcgactgtttcttttgctgcgccaaaatactgcttgtcgccagtgccggccgggaacacgagcgggtcaaaaataagatcacgcgggttgagcccgtacatatcgacgagcaggtcataagagcggcgcgctatctcaagtttccgttcggcagtgacagccatcccttcttcatcgatcgtgccgacgacaacggcacccccgtattttttgaggagcggcacgactttttcaaaccgttccgtcccgttttcaaggttaatggaattgacaatgctttttccctggcagtatgtaaaagctttttcgattacgttttcgtccgtggaatcgatcataaatggcactttcactttttttacggcgatcgaaataaaattttccatgtcactgatttcatcgcgatccgggtcggcgaggcagatgtcgatgatctgtgcgccgtttttgacctgggtacgggcaatttcgctcgcttcttcccatttgccttccgcgatcaggcgccggaacttgcgcgaaccgatgacgtttgtgcgttcgccgacaaaaatcgggcgggtggacgggtcatcgtaaataaagggttcgatgccggagacggcgtggtgctcttgttttgcaggctggcgcggcgggagcccggcaagtgcttcattcagtgctttgatatgggcaggtgttgtgccgcagcagccgcctgcgatgttgagccagcctttttcggcgaagcctttcattttgacagcgagcgattccggtgtttcgtggtaatgcccttcttcgtcgggaagcccggcgttcgggtaacagctcactgccgttttggcgagccccgcgagtgtgcggatcgagtcggccatgaactccgggccggtcgcgcagttaagcccgactgcggccggctgcatatgctcgacggaaatgtaaaatgcttcgatgttctggccggcaagcgttgtgcccatcggttcaatggtgccggagatgagaagcggcagtttttttccggtttcgttaaatgcgtccgtaatgccaagaaaagcggctttgacgttcagcaagtcctgcgatgtttcgagaaggagcacgtcgacgccgccttttatgagcccgcaagcctgttcctggtaagcggttttgagcgcgtcaaaagtagtgccgcccgtgacggagagcgtctttgttgtcgggcccatcgaaccggcgacaaaccgcggccgctcgggtgtggaaaattttttggcagcctgcttggcgatgcgcgcggcttcgatgttgattttttcagcgagatgcccgaggccgtactcgttaaggacgatggacgttgcgccaaatgtgttcgtttcgatgatgtcagcccccgcttcgagatatgcttcatgaatcgagcggatgacatcgggtgctgtgagattcaagtgttcattgcagccttcgtatgcttcgccgccaaaatctgccgcggtaaggtgttgctgctggatcatcgtccccatcgccccgtcaaggatgagaatgcggtttgcaagctgctgttcaaataacgtttgccccatgaaaaattccccctttggctgtacgtttgatattgagattgcgacgtacggtaacatttggtacctggctgggtcgcgttccgatgctggcggcgccggtgccacttttgattgagtttaaagtgcatgcatctcgcaggggctgaagccggccaaggtttcgttttgccttcttgagctcttttcttaatcttgcaattggacagtgctatcaaagtttcactttaatgaatccgcctgtactcttttcgttgcagtctcagacaatgcctgcgccttgcactgctgttttttcgtggatatagcgcgtgcattccaccgtcagttcgtagcgttcgagcggcgtaattaagtaaatgccgttgaaatagccgagggccgcgtcgatcagggtacggctgatcgcaaggctttcttcacgtgctttcgcagggtcgccatttgttttttccatcgccgccaaaatttcatccgtcagtttgatgcccggcacttcattgtgcagaaagaccgcgttccggtagctggtaagcggcataatgccaagatagatcggcgcgtccaaatgcttcgttgcttcatggatttgctcgattttttccgtgctgaacacaggctgggtgataaaataatcggcaccgtagcggattttgcgctccaacctcccgaccgttttatcaagattgcggacgttcgggttaaatgcagccgcgacggaaaaattcgttttcctgtgaagcgatttgccggaatgggagatgccatcattgaattgcttgatcattgcgatcagttccatggatgacaaatcgtatacgctcgtcgctcccgggaagtcgccgatttttgtcggatcccccgtgatggcaagcacctggtcaatcccgagcgcagcaaggcccattaagtgcgactgcagcccgatcaaattacgatcacggcatgtaatatgaacaagcggccggatgccatgtttctcttttaaaattgaagcaatcgctgtgttgctgatgcgcgggcttgcaagcgagttgtcggccattgtgagggcatcaatgccggatgcctgcagcgcttttgccccctcaaaaaagcgggccgtgttcaacgttttcggtgtgtccaattcgacaatgacggaacgccgtttttttacgatttcatgcaacggtggttcgtgctgcgccggggcggccgcgatctcgattttcggtgggcggaccgttttttctgtgacaggtaaaagcccctgcaccccttctgcgattgctttgacgtgagccggcgtcgtgccgcagcagccgccgatcaggcgtacaccctgttcgaccagtttttcggcgcatgttttaaaataatcggcgttattcgtgaacgtgaacctgccttcctcgtaatctaaaagactcgcattcgggtatgcggacaaaaaggcacgcttcggtatcgggatttcttcgaacgcctggatcatgtggtgcgggccgagccggcagttcaggccggtcacatcggcgccgcggttttcaagttccttgaacgcgtcgcggaccggggttccgttttggagcacgcccggttcgataagcgagaactgggcgatgaccgggacatccgcttcttttttcgcaatgtctacgaccgtatacagttcttccgcgtcaaaatacgtttccaaaagcagggcatcaactccttcgttcaggaggtgaaaaatctgctcgcggaacgtacgcttgatttcggcaagtgttgcttcggttttgcgttgtccgcggatgccgccgaccgtgccgagtataaatgtatcacggtttgccgcttcttttgcaatccggacggccgctttgttgatgtcttttactttttcttccaggacatactgtgctagcttgatatagttggcgctgtacgtgtttgtctggatgaccgatgcgcctgcttcgatataggcgcggtggatcgcgtggatgtcttccggatgggtcaggttgaatgactcataacatgtgtcggcgccgtatgcatatagcagtgtccccattgccccgtccgcaacaaggatgcggttttttaacgtttcgagaaggtccaaatttttacactccctttgaatgatatgaaaaaagcctcccagaaaaggaggcaagatgacaacattctccttatcttttcaggtatacctgttggatttagcaccgtgccttatgggctggttgctgaggtttcatcgggccaagtccctccgcctctcttgataaggctattcgattgaacgtacttaaaattttgacttatttatactttacactttgccgggtgacatgacaagggggaaattgaaattcatattggatgcggtttcgtcccttttgtctaattggctttcttttgcctttttgagccctccaaaaggacaatttgctcttggtccgactctcttttgtctttttgagctctccaaaaagacaatttgctcccggtacggctttcttttgtctttttgaactctccaaaaagacaatttgctcctggtccggctttcttttgtctttttgggcccttcaaaaagacaatttgctcttggtccggctttcttttgtctttttgagcccttcaaaaggacaatttgctcttggtccggctttcttttgtctttttgagctctccaaaaagacaatttgctcccggtacggctctcttttttctttttgaacccttcaaaaagacaatttgctcttggtccggctttcttttgtctttttgagccctccaaaaggacaattcgcccctgatccgactctcttttgtctttttgagctctccaaaaggacaatttgctcctggtccagctctcttttgtctttttgagctctccaaaaggacaatttgctcctggtccggctttcttttgtcttttagagctctccaaaaggacaatttgctcccggtacggctctcttttgtctttttgaacccttcaaaaagacaatttgctcctagtccggctttcttttgtctttttgaaccctccaaaaggacaatttgctcccggtacggctttctgtctgcaacaaaaaaaagagccggaaccggcccctgttattcatccaaaaactgtttgatggcttctatatttttttctttgtccacttcgagtgcggcgccgacgcccggatagctgacattggtataggtgccggcaaccggtacggtcattgtttttaccttgaggttgcctccgacggcgtctttggcgagcgcaagaatgttcattttgctcatattggtggcaatatacggctgaatggttccaagcagtttcggcgctttggcgataccgttcacgctgaaaacttcagattggagcgctttaagcactttttgctggcgggcaacccggccaaagtcgccttgcgcgtcatgtctgaatcgtgcgtaggcgagcaattgtttcccatgcatcagctgttttccaggataaagcgtcaagccgatgttttccgacattttatgttccacgttcatttcaatgccttgaggcgccagggtatcgacaattttaacaaaaccttggaaatcgacaagtgcataatattgcacatcaatgtcaaaattggttttgagtgtttgacgcagcaattcaacaccctttttttgattcttcagattgccaagatagtaggctgtgttaattttatagtttctataccccggaatttcggcataaatgtcacgcataatcgaaatgagcttcacctggttattcttcgggtcatattgggcaatcatgatggtatcggttcttgaatcttcttgcccgcgccgatcaattccgagaaggagaatattggtgcggccatttgcatcctttttaccgttaaattccagattgtccatatttaaggcatcattcgggtctgtctgatgaacgccagcgtagtattgataggctgtgtaacccgcgccggcgacgatgagcagtaaaaagagcataaggaacactctgcgccagcggactcttgaccgttttttcttttttttcgctactcttgactccatagaatccctcgttttagtagtctgtcttcattattattatctaaaagcggcaatttgtcacgaaaattttgatgaaattttgttatttttgtcgagatcataatttgtggggaatttcacataactttcatgcaaagttaaggcgttttttattttccagcggtatattgatgtttgtcatcaggtaagagcttttgttggttcgtctgctttgtgcaggcgtttttttatggccagagacgcggaggttttaagcattttttaagtttcggcaggtatccttttctttgcaagagagcttacaacctacttttttatatgcccccttttttaggccgcccttgtgcaggcggtttttttctgggcatagtgggcaagcctgcctcttttcggaatttcggcctgttaaggttgttttaagcttcctgcgttatcctttttcttgtaatcaagcaagatgaaaatccggcttgctttttcatccatgttaacccccttttttggccgtctgctttgtgcaggcggtttttttcggccatagcagataaacatgcctctttttcaaaatttcggcctgttaagattgttttaagcttcctgcgttatcctttttcttgtaatcaggcaagatgaaaatccggcttgctttttcatccatgttaaccccctttttcgccgtctgctttgtgcaggcggtttttttggttaaggattttgaacaattatagcagctaacctatatctttgatttggtgggagttagccgctcttgggatccgaaccgcactgtttccattcttccctcatctatggaaaaagcccggccccctaaatagagggtcaggctttttttttcttgcggtacatcgagtaagcgatataaagcacaatgataacgatcgcgataatggtcaccggcttgacataaggagccgcgacgtcatcaatttgtgcccagtttgatgcgagacgttcaccgagaaagataaacagcaccgcccacggaatggtcgcaagcagcgtgaaaaaaatgaacttgaaatacgacattttggcaatgccggccgggatcgaaatggcctggcggatgaccgggatgaatcggcccgtaaaaataacaccggcgccgtacttgttgaaccattcttccgcgacatcgagatgcctttcgtgaatcagcaaatatttgccgtactttagcaagaacgggcgcccaccgtatgcaccgatccagtataaaatcagttgggcaatcaaaatgccaagtgtgcccgctgcaatggcgccgaaataattgatctctccccgggaaattaaatagccggcataggcaaggacaatctcgctcgggataatctcaatcgcaagcccgatcgcaacaccgaagtaacccagatcagcgagtgctgttaaaatttgtgtgacaaagtctgagaacatgtttcccctccaacatttgctttcttatccatcatatcatacggaaaatttccagcaataaaatatttaagccaagccagacgccgccgaatacgtaaccgcccgcaatgttgctcgggatttcaaggccgaaataaatatggctgacagctgcgaacaacagaacagctaaaagaagtacatccataaacgtatggacccaaaacatctcagcgtgccggacaacgagatatgtaaaatagccgtaaatgatcagaatcatcatcgcctggtcgctcggaaatgagaagacaaagtgggaaaacgtcggaatttccgtttccgacatccggtggaacacttcatgcagcacattttgatacagttccccgccgattgtaacaagcagcataatcaaaaattcgtgcgtgcgatctttgcctttccaaatgatccaaagaaccgtcaacaccatgacgagaatgagcgcctgccgcgagctgagcgccagcatccctttcatgacgcctgcccaatggtgtttgaacaaaagcgatacgattaaagaggtcacctcgttaaagtcactgaaatcttcgctgaaaaggttttgaatcattgtgatcattaacacaatcaaaaacaatgtcaccagcgtggtgccgatgatcacaaactcggcgcggacccggctgcggaaaatcatgaaaacgcgccggagcaccgccatcatcgcccagaaaatctgcttatggaaatagcggaacacataatacgcgatgattaaaccggcgcttacaataccgcctatgacgagatattttttgaccgcttcgtgaaactgctcccactgcgggccaagcagcttcccgagggaaataaacgtgcttgtccaaatcaaagcgccggaataggcaaaagtggcaaatgaccggaatggcagtttcgtaattccggaaaaatagccggtgatgtggcggacacctggtataaaatacgcgacgataagcaatttattcccatatttattaaaccagcgcgatgttttttcaagctgggacgggccgagatggataaaatggccgtatttatgtaaaaacgggccgccgagccgctgcccgataaaataggccgttgtcatgccgacagatgtaccggtggcggcaatgagaatgctcaagatccagttgagctgcccctggtgcaccatataaccggcatagctcatcagcacttcgcctggaagcggaactgcaatcatttcgagcaaaagtgccaaaagcagcacaatatatccatattgatcgacgtatgatgtcactgacatttgtatccctctcttaaacggcgtcaataaaaacgaccgcttttgtttgcataaagttcactcttcttacagccattttcgggcatgaggatgggtttgtcaaaaaggttaaaacttgatatttgtcaattttatgataggcactttgcagggaaccatccaggtttaaaaccagcttctttcccggacccagcgtgttcccgcacccgtttttcgttaagttaagaatcacgttttctgctttcggctgctgtataagttgaactaaacattcctacttctgtatgtgtagccatcgtaattgattttaacgcgaaaaatttaggttcattttatatattcaccaggctttggggagttttttacatgaggcttattgtttcggtttccgtattttgccagggaacattcaagattcagtatttattttacccgctttcggccatgatacttcacccgtctccgtatggtttttacacctgtaaattttatttgagatttggaaggttcacgacttccctgttgtgatggcccagggaaaattttacagttgtgggtgaacggggattagaagagggcgtgaatgatcaagtccattttaacggatttatgaaagaagtctcccatcctcatggccaaagagcaggtgggagatcatttcaagcattcgcctgactgaatcgcaatggtaactacgcccaatcactgtctgcctttaggcttgtgtgccggattgcctgtttccgctgcgatttgattgctgaaaatttgagagccatttttccacgtttccataaaacttgttcaaggcatctgccgctttttcacggttttcttttgatttgaagtattggtagccggcaaagcctactgctgtatagaaaagtaattttttcaccttaaaaacctccctttctttactccctttattttatatgaaaattcaatggattggaagaactttacccagccaggacgcatcggagcattttccttttcgcttttttatttgggggcagcaccgtttcactgtgcatttcctctcattttcattttttcgtctttatttggggattttttagggccatttctgtcacgggtttgccagctttttcagcgaagcacagcagttccactggacagagattgttagctagttacttttagtaagtttacaattcatgtataatggttaaaaaggcttttgttgatatagccccggaatgcagggttgatgagaaaggtgcgttacaaaaatgggaaaccaaagtttatgtccgcgtttcgaaaaggcgtttcagctattgggaaaacgctgggttggcgtgattatccgtgtcctttctaatgggccgatgcggtttaacgaaatggcggagcttatcccgcatatcagccaaaaggtgctttcggagcggctgaaggagctggaagaccagggcatccttgtacgggaagtgtacccggaaagccctgtccggatcgaataccggttgacagaaaaaggcgaggcgatcaagccggtccttgatgaagtgcaaaattgggcagacaaatgggttgatcttgaaagtgaatgataaaaggggttgcttccattctttggagcagcccccttgttttttaagaaaagaaaacaccaagcaaaagcggaatcagaatgatgagcccgaggatgatccagcctgccgggtgcgcaaagttaagggtccagccgctcccgaaccttttttccacccataaggaaggatcgttgcgattgaagtaaaaaacgccgagtttccaatacgcatcgtcatcatactggaagcggccctgaacggcaccattgcctacgcggatgcggctgccgccctgcccggtgataaccgagagcaaaaccgccccggccacaatcaacaggaccgcgcccatgcctccgtacgacaaccaggcaatcgggaccggcacaataaaggaaagctgaatggcaaaaaatagtaaaatcataagcaagcctgtaatgatcataaatgctgaccatctgcgccggaaacggacattttgctcgagggaggcttccggtctttcggcattgagctgctgtttgctttttgcaatcatcgtattcagccaaatgaacaggataagcaagaacagctggacagttggcagttcaaacacggtccggtacgatttttccacccagtctgtcggtgtaccgttaaaatcataatgcatggcgatccggtccggaatccgtccgtagcacaaccatgtcatcaggaaagtggctgctgtcacgcttgcatggatcagaaaccatgcgttggaaaaaatgagtttctggctccggaatttcgggtcgacgatgatcgcctgctttttcccggctgcccagttccgcgtcttcttgattgccttcatttttcggtgaaaataaagatagatgagaaaattaccggcaatgtcaacaaggactgcgagagcgaaaccagtttgaagcaactggcttgtgcttacagctatgaacagggcggctgccagaaggatgctgaagacaataatgactgcggcgtattgtttcctcagttttttcagttcaggatccaggtaggctgcctctgggatggtgaccccaaaactttccgtttttcttgtaatgtacggtgttactgccatcatgacggcaaccattccgaaaaagattaataccattatggtttccattgttctcccaccttttgaatgtcgttgtatagcttttcgcatatttttaaaaattgcttttcgtccaggccgcggcagatcgcttcactgatgagcgggcgcagttttcccgtaaggctttcaagatatggttcatcggccgggggcatctggtcaggctggatgacaacccctttttgccggtggatctggataaagccttcctgcttcaagatttggtaggctttattgaccgtgtgcatgttgacgccgagatcggatgccatcgcccttaccgatggaagcgaatcgcccggtgccagctcttttgacgcaatcccttccatgatgctgttgtgcagctgttggtaaatagggacatccgattcaaggtcgattttcatgagcatgaacatcatctcttttatttgggttatttgttatatatattgtataacagttagcacaaaaaagcaatggggatttgatttattttgcaactttgcgaatgaaaatcagcaatcgcaaacatctctatcatgagaaaagctgcgcaaaaaaaaggaacctcaggacaggttcccctagagcaaattttctgttgtgttcacaagctgtttggcagcggaacggtccgggtcgaggcgcttttcgagccggcgcgcgagaatcgaaagcaagtagttgacaacaaaatacatgaaagcagccatgagcagaatcgggatgatgtattttgatccgccttccccgttgtaaatcccttttgcattgtgtaacagttccggcagtgcaatgatgatcgcaagcgacgtatcttttaaaagcgagatgaactggctcacaagcggcgggatcatttttttcaaagcttgcggcaggatgatgtaccacaaggtttggatatatttcaagccggatgaacgggcagcttcgatctggcctttcgggatggcgttcaggccgccgcgcacaatttcagcaatcatcgaggattcgaacaccgtcagcgccgaaatggctgctgccgtgacgctcattttcatgccgacttcaggcaaggcaaaatatgtaaagaaaataatcaaaatcagtggcaagttccgggtgatttccacaacaagtgccacgattggcgataaaattggaattttggcgtaacgcaagatgccgagaatacagccgatgagaaaactcaacacgattgcaacaaaagccacttccaatgtcaccgcaaaacccttcagcaaatacgccaggtttccacttgaataagctccggcaaaatccatcgcatttccctcctttaaatatgattcaactgcttctggccagccggcgttcaagatagttgacaagcaggctgagcgggatcgtcagaatgagataaaacatgccgacgaaaatatacgtatcaaaagtgatccatgttttttcatgaatgagatcggcgtagtacatgaggtcgagtcccgcaaaaacaccgaggatcgaagagtttttgaccaggttcaggaattggttgccgatcggcggaatgacgattttgatcgcctgcgggaggacgacgtaacgcatcgcctgggtatacgtcagaccggttgaccgtgcggcttcaagctgacctttgtccaccgattgaatgccggcacgaacggcttccgcaataaaagcggcggtgtaaatggagagcgctatggtgcccgcgataaagccgcttaaattaatatgaaaatagctgagcccgttatagaaaaagaaaccggtcaggattaacggaatattgcggatgacttcaacgtagactgcgccgataaaattcagcagtttcacgggggccagcctgaacacggcaatgaggttgccgagaatgaagctggcgacaaggccgatgatgctgattttgatcgtattgacaaaacctttcatgtataagtcgatattgtcggtgaggatggaaaaatcaagcacgctgtttcactcctttgcggtttaatcaggagaaagggatgggcgattttgcccaccccttatccttattctttgatccatttgtttttgattttgtcgtattccccgctgtctttcagttctttcaaagctttgttgacggcttttacgagtttcgtattgccttttttcattgcaatgccgtacggttctttcgtgaaagtgccacctacaacctggtagttcgagtcttgggcggccatgccgtacagaatcgagttgtcggttgtcagtgcatcgcctttgccggattttaaagccgtgaatgcttcttgatagttttcatactctaacacggttgtatccggagcggcttttctgacgttgtcaccagatgtcgcaccttttaccgtcaagacttttgtgcctttcgtcaagtctttgacgctcttaatcttgcttccttttttcacaaggagcgactggccggcgtcaaaataaacatccgagaagtcgaccacttttttacgatccggcgaaatcgtcatggtagcgacaaccatgtcaacatcgccgttttgcagcattggaatccgggttttcgatgtgacttctttcagttcgactttgactttgtcaccgaaaattttcttggaaatcgctttggcaatgtctacatcaaagccttccacatttccggttttcgggtctttgtagccaaatagatatgtatcatatttgactccaacgaccaatttccctctgtcttcgatttttttgatcggatcatcgcttgcagaaccggatccgcctgtcgattttgatttgccgcagcctgcaaccagtgctgctgccaaaatgaaaaccaatcctgctgctaaccattttttgacctttcccatttgaatcccccttttttatttatggtcaccgcgaaagcaagcgctttgcggaagtccccaatgataaatgttttatgctggtactgctttgagtagcacggtattcccgcgggccggcacctaccattccttggcttatggccatgattgcgcaccatccccggatatgaatgtatatgcaaatgcaaatggtttatgactgcgactggaaccggctttcccggcgattgacggccaccttacgtgtacccgatagccgcggatcgtttgctttcgatttttggcatcctgccccgcgtggtacaggttatttggccaccattcgtaaccggctttccggcgattgatgccgccatgtatggacctgataaccgcgtatggtttgcacccgatttttagcatcctgcccgggcgtgatgcaggatgtttggccaccattcgtaaccggctttccagcgattgatgccgccatgtatggacctgataaccgcatatggtttgcacccgatttttagcatcctgcccgggcgtgatgcaggatgtttggccaccattcgtaaccggctttccagcgattgatgccgccatgtatggacctgataaccgcatatggtttgcacccgatttttagcatcctgcccgggcgtgatgcaggatgtttggccaccattcgtaaccggcataccggcgatcgacggccgacatgcgtgtacccaatagccgcggtcgtttgcttccatttttagcatcctgcccggatacacatgttttgcaagtgtatgtaccatggcctgtggttaatggttcagcacacggtttaaaaaggtgcgggcgcgttcttcacgcgggtttttgaaaaagtcttccggcgtattgtcctcaatgattctcccctggtccatgaaaaggacgcggtccgccacttcgcgggcaaagcccatttcgtgcgtgacaactaccatcgtcataccgtcttttgcgagtgctttcataacgtcgagcacttctccgatcatctcgggatccaaggcagatgtcggttcgtcaaacagcataatgtccggctccattgccagccccctggcaattgcgacacgttgctgctggccgcctgataactgtgacgggtaggcgtttgctttatccggaatgcccaccctttccaagtagtgcatcgcctttttttccgcttcttccttactttggcccagcactttgatcggcgccagcgtgatattttgcaagacagttctatgcggatacaaattgaagtgctggaagaccatgccgatgtttttgcgaagatcgttgatatcggtttttttgtcattgactttcatattgcggacgaagagctcgccgtccgtgatgtcttccagacggttgatgcagcggagcattgtactcttccctgatccggaaggcccgatcacaacgacgacttccccttcttttacttcaaggttaatatcttttaaaacgtgaaaatcaccatagtatttgttgacatgacggaatgaaatcacatcatcacctcccggctgctcatctttttggtgtgcgcttccagtatttagaaaccttccattactccctattttagagtatatcaatctattcagataacatcaatatttttattgaaggtatttttctgttttttaagatggattttccgggaaaagttatttttttaaaatattaaaaacccaagcggtctctaggactaaagtctggtgagaattcaatgtcagaaagcgtttagcaaggaattcatctgtgaaaaaagccgttccaaaatgcttacctcttttggaacggctggtgtattgtacacattatgtttttttctttggctccgtactttggccggtaacttcaagaacatcaaggaagaacatcacaatgggaataccaagaatgagcccccacagaccgaaaaaatgctcacaaaaaattaaaatgagaaaagtgtaaaaaacaggcatattcgtttttgaggacatcagctgcggattcagcacataggcttccacggcatgcacgatgacaatcaaaatgaggacatacagtactttcattccgccgccgatgctgtaagcgatgatacagagcggaatgagcgagatgaaaacgccggcgaccgggataaggccgagagcaaaaatgagaatggcgagcccgaataactgcggaaagccgagaatccagaggccgatcgtggtaagcacggaattcacaacggcgataatgaactgggcctcgatcactttcccgaatgtccctacaaatttgacaccgaaatattcgatttcatcgtaaaacgctgcaagtttgctcgttttaaactgttttgtaaaacggataatccgctctttttcaagcaggaaaaacaaactcaggataatagccatgaagacctggatgctgactttgctgatgcttgtaaaataatcgagcaggatggaaacgcctttttgtgcgtagtcgacgattttcttttcctggatattttttacaatgtaattcaatacttcattgtgctggggtttcgtgtagaaatcggaaatttgtacaacaagctgggtaatttcattgaccaggatcggaaaatatttgatcacgccgaatgtgaggccgccaagaatcaaaatgtacacgattaaaacagccagtctgcgtttgattggaaaccatcttgtcacaattttttgtagtctgttgacaagataggaaaaaataaaggtgagcagcatcaggtccatcatgctgcgcagaaaatacaggataagtgtgagcagcacaaagataaggacccttctgaccccccgtttttgaaataaagaaaacagccggtcttccattgtattgttattgccccctccgattcaaaggaaccatttttctttttacccttatcttaacacatttatagccggttcaagtaatttagtcggcgagggatatgtaaaattttttcttgccataaaaggaaatataccacacagatgaatcagcccacggggagcccgcagttcccgctgctatataaaatgaatctaagtttttcgcaccaaaatcaattacgatcaggatagacattgcttctggctactaatgtttggttcaacttatatagcacgatcaggaaaattgattccgtccccggggaaggacgttacggctgcattttcggcccgtgaaggtgtcagggcggtcgtctttcggtgttttaccgtgaaaaatgttcggatgacggcagcgcgaataaaaaactggctgctgcgtttttcgcaaaaaggatcagacattttttgcagcactggcaatgagatgaaaagtggcagtatgctggtcgtatttttacacgacggctcgtgaaggtgtcagggcggtcgtctttcggtgttttaccatgaaaagcgttcggaaaatggcggggtgcatgcaaaaaatgggccgctgcgttttacagcggcctatggttatgatttactttttttcacttgcggcttttcttcttcgtcaatggcgtcacgcacgccttttttgaattcgcgcaatgtttggccggctgcccttccaagctgcgggagtttcgacgggccgaaaattaatagggcaacaacaagaataatgagaacttcgccaaagctgagatttccaggcattttttcccctccccgggcttctttatctttatcttatagtgtattgtaaacattttcaacttataatcacttgaattcaatttattttctgattaagcatggcggggttcgtaaaaaatttattcgttttggccggtgtccatggtagaataatgtagtctggaggtgacgtttttgcatttgtggaatttgtttgtggccgcaattctcggccttgtggaggggctgacagagtttgccccggtttcttcgacgggccatatgattattgtggatgacttgattttgaaatcgaatcatctttatggcactgaagcggcaaatgtatttaaagtggtgatccagcttgggtccattatggcgatggttgtggttttttgggacagatttttaaatttgcttggcctgaagaaaaatattacgagagagcagatgtacggtgaacggctgagattgacgcatgtgattaccgggctcgttccggcggctgtgctcggctttttgtttgaagactatattgatgcccatctgttttcggtgaatacggtacttgttgccctggtggttggagccattttgatgattgtagcggatctcacgcgcccacgtcggccgaagacggagacggtcgaccagattacatatagacaggcgtttgtggttgggctttttcaatgtcttgccctgtggccgggtttttcacgttccggctccacgatttcaggcggcgtcttgcttggcatgagtcaccgtgcggcagcggactttacgtttattatggccgtgccgatcatgtttggcgcgagctttctttcgcttgtaaagcattggggtgccgtaacacctgagacgattccgttctttattaccggattcatcagcgcgtttattttcgccttaatcgcgatcaagtttttcctcgcactgatcaacaaggtaaagctggtcccgtttgcgatataccgcatccttttggcgattgttttgcttcttttgatttggaaccgataagattttggctgcgcggcgttgcgcggcttttttattttggcttttgccgcgtttgatgttgaacgaagcgtctacggtaatttgttctgctcatcaaaaaaggctgccgaacgcgtggcgggcagccttttttgatacagccgtattgcagtgaaaatggtgcatccagatttgttattttttaaaatggtagggcattgttgcaacgacaacgtctttttcccagagaaggcgcatccggatgaggagcgcggactggttgtgcaaaatgttttgccagcgttttttcggaatgaactgtggaatgagtaccatgacctggtacttgttttcttttgctttccgctggataatttccaaaaatttggcaagcggctggacaatgctccggtaagacgagtgcagggtgacaaggcggacaccacagtcccactctttccatttttcttccattctcttctcgtcttcatggtcaaaagcgacataaacggctatgacctgatccgagagcgattttgcataattaatcgtccgttccacgaccgttgtaatgccggccaccgggacaatgatcacattggagtggatttcttcctgaaacacccctttaatccgcaactgctcgccgaccgcctcgtaatgccggttcactttccggaaaataaacatgacgatcggcaggaaaatcaaaaccggccatacttgcgtgaatttcgtaatgaataaaatcgcaaggacgctaaatgtaataatggcaccgacaaagttgaccgacattttgccggcccagcctctcggtctttgagtgacccatttcacaatcatgccgcattgcgcaagggtaaacggaatgaacacgccgactgcgtacaacggaatgaggcgctcggtattgccctggaatgcgataattaaaatcatggaagcaacgccgagaaaaataattccgtttgagtaaccaagccggtcaccgcggatcgtgaacatgcgcggcataaatttgtccctcgccaagttaaaagcgagctgcgggaacgcagagaatccggtgttcgcagcaagcacgagaattaaagccgtagttgcctggacgaaatagtacaaaacaccgttgccaagtgtccggtgtgccatttgcgatacaacggtttctgtttctttcggcgcaatgccgagccagtatgcgagaaaactgatgcccgctaaaagcgatgccagaatgatacccatcatggcaagcgtgcgggctgcgtttctcggtgccgggtcgcgaaagttcgggatcgcgttggaaatggcttcgacccctgtcaatgccgaacagccggatgagaaagcttttagcaaaagaaacagtgaaatgccggcgaccggcgtaccgatatgcggatgcaggttttgcggaacttgccccgttacggttttaaataaaccgacaacaatgatgacaatcaatgcaaatacgaacaggtaaaccgggtatgcgagcacattggctgattccgtcagcccgcgcaaattcaaaatcgtaatgatcagaacgagaaaaaccgcaatctgcacactgtacggatgcaagctctgaaacgcggaagtaatggcatctgttccggctgagacggaaacggccaccgttaaaatgtagtccaccagcaaggatccgcctgcaagaaggccgggggtgacgccgagattttctttcgagacaaggtatgccccgccgccttgcggataagagtaaatgacctggcgataagataaaataagtgcagccaataaaattaaaatgccgactgtaattggaatagaataccaaaatgccagcgtccccactgtggcaagtacaatcagcacctgttcaggcccgtatgcaacagatgaaagtgcgtcggatgacagaatggccagtgcttttaacttggtcagcttctggccttcgagttcatttgaacgcagcggtctcccaattaacaatcgttttatcgtggtgaacatttgaattgtctccttttatctgcagtgtttcaaaaatgcttccccaaaaataagaaaaaccacaaagagaatttatcttccctgtggtctattgcccgatcacagtttcacatcctctcttataacgctgacggggttagctgtcgggttcgggcataagagtggccctgcctttttaaaaaaaggcttcaccccaaagcggcgcgcggccgccaacctggttcccccgttccgtttccggattaagcggttcagttatgaaacacaaatttttcatacgacatcctatcttactcccgttaccatggtttgtaaagactatttcgcaattgcgtttcggtatgtccatctttacccgccatatccccgggcaaactgtctttgctcacagtacctaattttcgatcatgcttcttttgtagaatatccgaatgtgcccaaagcatgcaaaaagcaaggtttttcggcaaatccggagtaaagagataaacagagttaggaaggtaaaacctgaggatgaaaagatgacctcttggggcaggcggatcaattggaaacataagaccaaaagaggcgcgaacccggtggaattgtctaattaggagctccattcgggcccgaaatgtccttttgaacctgtcaaaaggacaaaacgtgccgcatccgggaatgaaatgtccttttgaacctgtcaaaaggacaaaacatgccgcatccgggaatgaaatgtccctttgaacctgtcaaaaggacaaaacacgccgcatccaattagacaaattaggcgaaaacccgttgaaaatgtctaattatggtctaattaggcgttccaaacgccaaaatccattacgatcaggatagatttgcttatggctgtccggcgcaccaacaaagaaaaaaacccgcaagttgcgggctttttttaaaacttaattttttcttccaaaaaggctttaagttccgtgattggcacacgggtttgctccattgtgtcacggtcgcggacggtcaccatatggtcgtcgcgcgaatcgaagtcgtatgtgatgcaaaacggtgtgccaatttcgtcctggcggcggtagcgcttgccgatcgacccggtttcgtcaaaatcaaccataaacgttttcgacaaatccgaaaaaatgtcgcgtgcttcagctgataattttttcgacagcggcaaaaccgcggctttgtatggcgcaagggccgggtgcaggtgcatgaccgtacggcttgtgccgtcttcaagttcctcttctgcataagagtcaatcagaaatgccagtgctacacggtccgccccaagcgacggctcaatacagtacggaacaaagcgttcattcgtttcctggtcaagataagtgaaatcctcgccggaatattccatatggcgtttcaggtcgtaatcggtacgggaggctatgccccacagttcgccccagccgaacgggaagttgtattcaaagtcggtggtcgcgttcgagtagtgggatagttcttctttttcatggtcgcgcagccgcaagttttcttccctcataccgagattcagtaaaaactcgcgcgcatactgtttccagtagtcaaaccatttcagctcttcgcccggcctgcagaaaaattcaagttccatctgttcaaattcgcgcgtgcggaaaatgaagttccccggggtgatttcgttccggaaacttttgccgatttgggcaatcccgaacggcaattttttacgcattgtccgttgtacatttttaaaattgacaaaaatgccttgtgcggtttccgggcgcaaatacaattcattcgtgctgtcttcggttacaccctggtacgttttgaacatcagattaaactggcgaatgccggtccagtctttgctgccgcaatccgggcaggcgatgtcatgctctttaatcagcgcttccattttttcaaacggcaggccgtcaacaatcatgtcgatccctttttcatgcagggcattttcgatcagtttgtcggcacggtgccgagctttacagtgtttgcagtcgatcatcgggtcattaaaattgccgaggtggccgcttgcttcccatgtgcgcgggttcatcagaatggcagcatcaaggccgacattgtacggcgactcctggatgaattttttccaccaggcttttttaacgttgtttttgaattcgacgccgagcgggccataatcccaagtgttggcaagccctccgtaaatttccgaacccgggaaaataaacccgcggtgtttcgcgtgcgagacgatttgatccatcgtgacgctcattgtcatctctccttttttcattgaaatggtttcccctggggacgggaatgtttccatataaaaagctcccggctccaggcaacagcctggggacgagagcttgaattcccgcggttccaccccagttgatgcgaaattttcgcacccactttccatgaaaaaaactccggactgccgtttcaccgggttccttgccgggcttccaccgcccccggctcgctttaaaaggaaaagttccggctactattgatccttcatcgtcgctatttgaatagaaatactataccaaacctgggcaggacaagtcaatgcccgacttgctttggaatgaatgtagtaatcgcgttattgtgacagaggcttccgcgctttgccaaacccttcgctctttccgggaatgttttgttgaactaccggggcggaccggaccgtactctccggttcacctttccggctccaaaaagacacgctttgtcttttttacatggggtacataagaatccccgattaataaggattggcaatttgaaacaaggtcagcttttgttccatcaggtttaaaaccgggtacccttcgactttaaggacaggctgatttggatgaagcggatggatccggataatgctccctttcaccccgttacggagtgtaatcggttgtttccggtaattttccatcaggaagttggcaaacgggaggacaatttcccgatcgagccggccggcatcagcatctgccattaattcgtcaatcgcaaaaaacaccggctgcctcctgcggtatgcgcggttggaacaaatggcgtcaaacgtatccgccacagataatattctgacaagaaaaggaatggttttcctgccatccgggtagcctgagccgtccagccgttcatggtgcatcaggaccccttttaaaatcatcgggtcaagcgatgttttctcaagcagccggtaacccgcttccggatgcttcttgatcaaggcaaactcttcatctgttagccttcccggtttattgagaatttgcgggtcaatggtgaacttgccaatatcgtggaaaagccccatttgcgccagcaggctttgcttttcgggatgcagcttcaaaattttcccgatattggcagcgatcagcccgacatggatacagtgtttgaacaaatattcgtcagcggagaaatgctccattagttccaaaatagacgtccgggtggcaaacacttctttgtaaagcttgcgaaaatttctttccatactctccacttctgcatcacaaagggttgttttcacttgaatgatgtgctggagctcttccatttcatggtaaatattctcatataataagtcatggaagatcccgggcgcttcggtggcaatgcgcctgccgtccagttgcggatcgaggatgacttcatatttatttaaaatggcagcaagcctttctgtaagaaacgtcccttttcgcagcaacaggacgccgctattggaatacaaatcttctgctaacttttccccttttcgaaacaccattgaaaaagctccccttgaacgtactttttttacattttaacacaggaaatgttagtgaaaaggagcctttccgatttttcttaaaaagttcatttatgttccgctgcctgccatgattttcgacttcaaacaacggaccatctccgcacaattctcaaacggggagcaactttgcttttttgaatttccacctcatttcaaatttctcgtactttcccgcgtttcagaagatcaagcccacgcaatatcccgttctacttcaatttttggcgcgggtttcctacttcaaaaaacaaaatcctctccggacagacatcgtgctctgcatggttgcttgatattcggttttttcagctcccgccgcgctttctgtttcagaaaacagaccgctcccacgcaattttcgagacaaacgggcatcggctttgctttacttggattcccgcatctattttagctttcccgtcacacttcctgtttcggaaaaagactgctcccatgcattttccgcaacaaatgagtatcatctttgctttgcttggatttccgtgtctatttccgttttccgccgcacttcggaatacagactgctcttttggtgcgggtttcctgttttagaaagcatcctctccggacagacatcgggctttgcatggttgcttgatattcagttttttcagcttcccaccgcgctttctgtttcagaaaacagaccgctcccacgcaattttcgagacaaacgagcatcggctttgctttacttggattcccgcatctattttagctttcccgtcacacttcctgtttcggaaaaagactgctcccatgcattttccgcaacaaatgagtatcatctttgctttgcttggatttccgtgtctatttccgttttccgccgcacttcggaatacagactgctcttttggtgcgggtttcctgttttagaaagcatcctctccagacagacatcgggctttccatggttgcttgatattccgttttttcagtttcccgtcacactttctgtttcagaaaacagaccccgcgcaattttcgagacaaatgggcatcggctttgcttggatttccgtatctatttcagctttccagtcgcacttcctgtttcggaaaaagacttctcccaagcaatttcacgcaacaaatgggcatcggctttgtttggattccgtttctttttcagctttccgccgcgctttcctgtttcagaaaatggatgacttccgcatagtttcccgtaacgagcgccgggttttgcaacgattcctctattctttttgtatcatccgtttcgacgagaacaaatccgggaaacgcctgcagctggatcaacggattaatgcgacggatatcttcatattgataatgcagctctaaggagacatgatccatttcaagaaacggcacatgctcttcttcgtaccaatcttcatctgttacaacgatcaaagtataatagcgccggttttccgctgcccgtgaattgcctttttcactaatgatccggtcaacgcaaatcaggccgcccattatgatgaacgcgaatacagcgtacagccataaatgggacaacaacagcaataccgctgtaatcaacgaaaggatactcaacctttttgccaccatttgaagcagtaaaaggacatcactcatcattcacgtctcccaattcatgatgtaaaaaatactttcctatatgatatgcctgcatggtttgatcggtgcttttcattttcgtttttttacagattggaacataataaaaaagcgatagcaaccaggaaaggagcatgaccatgagcaaatacgataaactgtttgaacccattacgtttaaaagcggcgtcagggcggaaaaccgcatcgtgatggcgccgatgacccattattcctcgaatgatgacggcacgatttcggatgctgagctgcgttattatgcagaacgtgcaaaagggccggggatggtcgtgacggcatgtgccaatgttacggaaaacggcaaagcgtttaccgggcaacctggcgcacatacagacgaaatggttgagagcatgaaaaaactggcacaaacgattcagcaaaacggtgcaaaagcggttgtgcaaatccaccatggtggccgcgaatgcccggctgaactcgtgccgggcggagatgttgtgagcgcgagtgaaacagattcgtcagatggcagtgtccatgcacgcgcgttgacgggagaagaaaccgctgaaattgtgaaggcatttggcgaagcaacacgccgcgtgatcgaagccggttttgatggcgttgaaattcacggtgcaaacggctatctgattcaacaatttttctccccgtatacgaaccggcgtgaagacgagtggggcggcagtctggaaaaacggcttgcattcccgcttgctgtcgtcgatgctgtgaaaaaaacggtggcggaatatgcggaccggccgtttttagtcggataccgcttatccccggaagaaccgtacgaaccggggattacgatggatgacacgttcgcgcttttggatgcgctgatggaaaaagagctcgactatgtgcatatttccctgcagcacttctggtctaaagcccgccgcggcggtgaacccggccgtccgcgcatggaacagatcgtggaacatgtcgcaggccgcgtgcctttgatcggcgtcggctccctgcacacaggagacgaggttttgaaggcaatggaaaccgatgtaccgcttattgccctcggccgtgagcttgtcatggagccgcattgggtggaaaaaattaaagccggccaggaggatgcaattcaaaccgcgttaagaaaagacgaccgcgaacggctcgttattccggaaccgctgtggaagatgatcatctcaacgccgggctggttcccgtttgcagaatgacatctgcatgttgcacggcattgtcaaagaatgaatggctgcgcttgcgaggctcggttgatacacgaattgaagtttacgtaatggccaaggaatgaatggctttgccgcgaagctcggttggcgatcgaattgagcatacgcaattgtcaagaaatgaatggctttgccgcggagctcggttggcgatcgaattgaagcatatgtaattgccaaagaatgaatggctcactgcggggcccagttggcgatcgaattgagcatacgtaatggtcaagaaatggttggctttgtcgcggggctcggttgacgaagcatatataatggccaaagattgaatggctcactgcggggcccagttggcgatcgaattgagcatacgcaattgtccagaaatgattggctgcgccgcgaagctcggttgacaactgaagtgaagcatatgtaatggtcaaggaatgaatggctgcacctgcctaatctggcctagagctagagccggagtatatggatgcgatggaatgggcatcattatatataagttggcatgcaatttttgggctggaattacctaccttctccagttattgattgacacgcattgctgcgggttttcagcacgcggcttttgcgcgacttacggcgtgcccgaatttgttcccgcaaacaccgttaacaatgcaggattctgcctggtgtaagaaccactatactgcaaaagaaagtgcaaaaagcaccattaacatgcaggatgttgcctacctgctgattcagaaaccgaacccttttaaaaaaagggttcggttttcttgacttttttaacttacgatattaaactaagttacgaaaagtaagttttaaaaacaggaggaatttaggatgacaaaaacaaaatgggcagttgactatgcacatagcaccattgatttcacagtaaaacatatgatgatttcaaaagtaaaagggtcttttcaaaatttcgaagccgaaatcgaagctgatccccaagatttaacggatgcaaaagtttcttttattgttgatgccaggagcattcatacgaaaaatgatgaccgcgataatcatcttcgttctgctgatttcttagatgttgaacaatatccgaatattacatttgtttccaagtcggttacaaaggcaggggacaatgattataacgttaccggtgatttaacgattcatggcgtgacaaaagaagaaacatttaaagtcacatttgaagggatttcgaaaaacccgatgagcggcgcggaaacagccggctttagtgcagaagggaccgtaaaacggagcaattacggccttacttggaacgcagcccttgaaacaggcggtgtcctcgttggcgatgaaatcaaatttacggtggaattagaagcaagcaaagcggaataattgcggaggcgccaatttagattggcgcttttttctttgggcagatcatgcttcttatggccaaggttttgggatgctttttttctattaaataacatagccgggctctaggtgaagaaagaccgtcttttttccgcgcttccttaacttagacgcactctatgtgaagaaaggacatctttttttcgtgcttccttaacgtagacgggttctatgtgaagaaaggccgtcatttttccacgcttccttaacaaagacgcactctatgtgaagaaaggctttcgtttttccacgcttccttaatgtagacgccttctatgtgtaggaaggccgtcatttttccacgctttcttcacatagacgcactctatgtgaaggaaggccttcgttttttcgcgcttccttaacataaataagaactttcctcaattgctgtgatgtgcatcacaaataagcaggtgctgatggtttatgatgaaggcagcaatgaaatggaggagtgaattcgatggaacgttttacaacgagccagactgtcggggaaatcgtaaccttattcccaaaagcggcggatctgtttaaagcaaatcgtatcgatttttgttgcggcggcaatgtgtctgtgaaagaagctgcggaaaagcgcaacctatcagcagatgaactacttgatgctatttgcaacctttatggccaatatgccggaaaaggcactgagcaaaattggaatgaagcgggctatacggaaattgtcaactatattcaggccacccatcacgcgtttttgcgcgaggaactgccaaacttgagcccgtatgtaacaaaagtgatgcgtgtccacggcggcaaccacccgcatctcatcgaagtgcatgaactgtttaaccaattaaaagcagaactgctggagcacactgaaaaagaagataccgaacaatttcctgccattcgtgcatacgaaaatcttccaactgccgctaacctgaaagccgcgacagccggtttgaccgaccttgaaacagaacatgctgctgtcggggaaattttgcaccggctccgcgaaattacgaatgactatacgttgccagaaggggcatgccgtacattccagctcgtataccaccgccttgaaaattttgaaaatgatacattccagcacattcacctggagaataatattctatttaagcggttgctcgaagaagccgtttgacttttaaaaggctgtcctcccaggcagccttttaaaaaggggcggtttgctttttatttttctttcctggccccggggaaagacaactcgttgcgcgtgcgttcctcttttgtcgttttgagacctccaaaagaacagtttgctcggattccagctctcttttgtctttttgaaccccccaaaaggacaatttgccccgggtccggctttcttttgtctttttgaaacctccaaaaggacagtttgcccggattccagctctcttttgtctttttgagaccttcaaaaggacaatttgtacggatcccagctctcttttgtctttttgagaccttcaaaaggacaatttgccccgggtccggctttcttttgtctttttgagacctccaaaaagacagtttgcctctggtccgactttcttttgtctttttgagacctccaaatggacaatttgctcggattccagctctcttttgtctttttgaagcccccaaaaagacaatttaccccgggtccggctttcttttgtctttttgaaacctccaaaaggacaattcaccccgggtccggctttcttttgtctttttgaatcccccaaaaggacaatttgctcggattccagctctcttttgtctttcataactccgatgaaagacattttgctgcgtgggcaacccccttttgtctttcatcaccttgatgaaagacaattcgctgcgcgggcacttcacttttgtctttcatagctctgatgaagaacatttcactgcccggacgcccctcttttgtccttcatcaccccaatgaaagacatttcgctgcctggacgcctctcttttgtccttcatcaccccgatgaaagacatttcgctcccacgacgcccccttgtctttctttgctttaattcttaccggcgggaaaatctttataccccgagcagttcctccgtcagtttttcctggtgaatgaggtatgtgcctttttcctgcgggaggatgaggtttttttctttaagctggcggatcgtgcggctgaccgtttcacgggtgacgccgatcatgttggcgaggtcggagttgttgagcggggttttcacgaggacaaacccgtctttttcctgaacgccatgtgtgcgggtgaggcgcagaaaaagtttgactacttgctcgtaagcgttgtttaaaatctgggcttcgagccggtcctgcaagtcaaggatttcatcactcatcacaccgtataaagtcatggtcagctgcggattgttgagcaacacgttttcaaaatcagtaatccggatcgcaacgagattcgtgtctacaaccgccatcgcattcgccgggtagcttattttacggaaaaaaccaacatgcgggaacatgtcgccatcgcgaagcagtgtgacaacttgctctttgccgttcgcatcggtgcggtaaattttcacttccccgctttcaataaaataaacggcttcctgcgggtccccctggaaaaaaatatgcgcatccttttctgcatgctttttaacagatatatcggcgatcacagccagatccgcgtccccgagtcctttaaaaagcggcattttacgcaggttttccaaagcgctcacttcccttcttcaataaagtgcaattatccctcaattactcggtattctccaaatttcatagatatcattacgtagctgcaggcggcctgctggacaaatccctcaacacaccctattgtacacaaaaataagcacaccgcccaaagtcaaagtcaatgttaaaaaaataagagtgtcccccctcggaacgcctcttatccttccttcaataaagtgcaactatctctcaattaccccgcgtattctccaaagccaatgttaaaaaagaagagggccccaatcggagcgcctcttattaagaaggaatcgattctgtaggatgggcagccgtttccagtgcttcctttttgtcaaattctttttccgttttggagatgacgaccgtcgcgacggcattcccgataatatttgtgagcgcgcgtgattcagacatgaaccggtccacgccgatcaacagcgcaatccctgcaaccgggataaccgggaacgcagacaaagtcgcagcaagggtaatgaaaccggaaccggtcacgccggccgcccctttcgatgtcagcattaaaatcagcagcagcatgatttggtgcccgatcgtcaggtgcacattatacgcctgcgcaatgaaaatggatgccatcgacaaatagatggcggtgccgtccaggttaaacgagtatccggttggaacgacaaggccgacaaccgattttgaacaaccgaatttttcgagttttctcatcagggaaggcatcgccgattccgatgaagaggtcccgagcacgagtaaaagttcttcctttatataagcgatgaacttgaaaatgttgaaaccaaacgcttttgcaatcccgccgaggacaagcaagataaaaatgatcatcgtcaggtagacagaccccattaattcgccgagattgatcagcgagcttgcgccaaactggccaactgtatatgccattgccccgaatgcagcgatcggtgacactttcatgacaataccgacaattttaaagaaaacttccgtcatgtcttcaaaaaagcggataaccggttttgccctctccccgagggatgcggcagcaaccccgaacagtaccgcaaaaaataaaattggtaaaagatctcccttgacaaaagccccggcgatgctttccggaataataccggaaataaaaccgataaaaccgtgctcgctgtcttttgcctgcgtgacgaattgtgaaacctggcttgttttcgcatggcttgtatcaatgccgtggccgggttggatcaaattcacgataatcagaccgatggcgagcgcaaccgtgctgacgacttcaaaatagataagcgccttgccgccgattcgaccgacttttttcaaatcccccatgccgccgatcccgataatgaccgtaaagaagataatcggcgggacgagcattttgatcagtttaataaaccattgcgcgagaatattcagttccgcgccgaatttaggtgaaacaagtcctacaataatacccagaatgatgccgataatgacttgtactgtaagattccgaaagttgatcctcatttgccatcccctctgtttgcgcttacattttagtgtcatccattatatttctattatagtacaggttttccctgttttcactatttttatattaaaaaaattttgcttttaaaaaatatcggtgcaagcaaagcgcaaaaaagcagcggggcagatatccgctgcttttttctagctgtctttgcttgttacttccaaaatgaaaccaatcctttttcgccaccagggtctgtgctctttcccggaacaagtttacacttccgggaccgcttcccgcaatgcttcttccaattctttcctgtacgcctgttctgtctcttcatcccaggaaaattcagcggccatccatgttataaccggctctttccatttgcggacccagttgatatcgaagaaaagggcaccggtacggcgaatgaagaaatcgaccggttttaccaccatttcttgttccactgcatatttcaatacggcgtacacttcccgcggtagcggatagtcgtctttccagcttttcgcatatgcatatacgtgatccgcgttcgtgccgtatttttccgcaatcgcccggcttgcttccgcagacaggccgcttgcttcgccttcttttgtttttgctttgacaaacgccggcaaattttcagagccgcccacatcaccgccggaaatcggcaagtgcttcgtttggcacggctgaaaattgccgccaagcctgcgtgctacaagatctacaaccgtttccgccattttccggtaaccggtcagtttgccgcctgcgattgtcacgaggccgctgtcggattcccaaatttcatctttacgcgaaatttcggaggcgtcttttccttcttcgtaaatcaatggacggacgccggcccagcttgattcgacatcacgggctgtcactttgacttttggaaacataaagtggatcgcttttaataagtaatcaatatctttcgggagcggtttcgggtgaatcgggtctttgtcgtaaaatgtatccgttgtgccgacgtacgttttgtcgccgcgcggaatggcaaacaccatgcggccgtccggcgtatcaaaatacacggcctgccggagcggaaagatactttggtcaaacacaatatgcacgccctttgtgaggcggaggcttttgctccctttcccgtctttattgcgcattttgtcactccacggcccggtcgcattgacgaccattttcgcccgcacgtttacggtttccccgctgatctggtcacgaacagtggcccccgagatgcggccgttttcatataaatactcttccgcttttgtatagttgacagccagcgccccgtgtgcgactgctgctttcatcacttcaatggtcagccgcgcgtcgtccgtccggtattcgacataataaccgccgcctttcagcccatcttttttgatcagcggttccttgtttaaggtttccgaagccgacagcattttccggcgttccgtttttttcacgccggctaaaaagtcgtacagccgcaagccgatattcgttgtaaatgcgccgaacgtcccgcccttatggaacggcagcagcatccattccggcgttgtcacatgcgggccgttttcataaacgatggcgcgctcttttccgacttccgccaccatttttacttcaaattgtttcaagtaccgcaggcccccgtggacaagtttggttgaccggcttgatgtgcccgccgcgaaatcctgcatctcgacaagcgctacagacatgccgcgcgacactgcgtcaagcgcaatgccggcccctgtaatgccgccaccgatcacaagcagatcgaacgttttatccttcatgttttgtaaaactgccccacgctcttttcctgaaaattccatttttgtcccctcctataaaataaaaagagacctgaaccatgcattatggaaaactcccataaaacaagccaggtctctctgcatctcttgacattttatgaacttgtttttattataacagaccttccgctgattttcagctgttatgcaccgggaaaatgtagtaatccccgtttcttgccgttgccccgttagataaggcagcgccggaaaaacatggaaggcaacgccgcccgaatagcaatagctggccacatcaactcacaggttaagctggcgcaaaactattgattgcctgctagtattgcggctaaaacatagacgcaatggcgccagaacgatgagcgataacaacgcaatagctggctacgtaaaagcttacgcaaaactattagttgcctgctagtattgcagctacccagaatccaaggtgttattgccatggtatccctgcaagctttttaaaagcaggggccgcctgcaacagcaatgctagcgcagggtaagccacataaaccacgttgcctactgcatacccgcttccgtatggctgcccagttcggtcgcagggtaagccagattacccgtgttgcctactacatgcccggttccgtacagctgctcaatttgggtcgcaggttaacccagataaaccacgttgcctactgcatgcccacttccgtatgactgcccaatttggtcgcaggctaagccagattaccgcgctgcctgcagcaatctgcaaatctatttaaaggcaatggttgcacggattgcttttttccatccgtcatataaggcttcgcgttctttttccgcgagtgacggttcaaatttgcgttccactttccactggcgggcaatttcttcacgcgattcccagtaaccgaccgcaagccccgccaagtatgcggcgccaagtgcagtggtctcgctcacaaccgggcgctcaaccggcacgcctaacatgtcgctttggaactgcatgagaaaattgtttttcactgcgccgccgtccgcacgcaatgttttaagcggcagtccggaatctgcctccattgcagcaagcacatctttcgtctgataggcgagcgattcaagcgtggcccggataaaatgttctttcgtggtgccccgtgtcagcccgaacaccgagccgcgcacatcgctttcccagtacggtgtcccaagcccgacaaatgccggcacgacatacacaccatctgttgaatcaacccgctctgcatacgattcactttgagcgctgtctttgatcatgcgcatcccgtcacgcagccattgaatcgctgaccctgccacaaagatgctgccttcaagggcatactcgacttttccatcaataccccatgcgagcgtcgtcagcaagccatgcttggaagaaacagctttttcgccggtattcatcagcataaagcaaccggtgccgtacgtatttttcgccatcccttcttcgtagcacgcctgcccgaacagcgccgcctgctggtcgcccgccacgcctgcgatcggaatttcctcaccgaagaaatggtacggtgcagtttgcgcataaacatgggaggaaggtttgacttccggaagcatcgcagcaggaacgtccagcatttcaagcagctcgggatcccatttcaaatcgtaaatattgtacaaaagtgtccgggacgcgttcgaatagtcggtaacatgggctttgccgcctgaaaatttccagatcagccaagtgtcgattgtgccaaacaggagctcgcctttttcagcgcgttctcttgctccgtcaacatggtcgagaatccatttgatttttgtcccactgaaatacgggtcgatgaggagccctgttttttcacggaccatatcagcatagcctttttcttttaagtcagcgcaaatatccgctgtctgccgcgactgccagacaatcgcattgtaaatcggatgacccgtctttttatcccagacgaccgttgtctcacgctggttggtaatcccaatcgcggcaatctgcttcggctctacatctgcttctgttaaaacggtcgtcgtaaccgcgagcaccgatgcccacacttcattcgcattatgttccacccagccaggctgtggaaaatactgatgaaattcctgctgggctgtatgcacaatttcccctttttggttaaaaagaatagctcttgaacttgttgtcccctggtcaatggataaaataaatttctccatcccgtttcctccttacgctctctttttcttgttttctatcatccatactatcaataatacaagtaaacacgttagcaaaacacaccaaaacgcgggcgtccaatcatttttaaacacagcccggtaaaaaacgcccccgagagaacccccgagcaacggaccggcaaccggcacccacgcataaccccaattcgaaggccctttccctgcaatcgggagcagaaaatgggcaattctcgggccaaggtcgcgggcagggttgatcgcataacccgtcgtcccgccaagtgaaaccccgatcgctacaatcagcatgccaacgatgaacgggttcagcccgtctgtaaacttatttgccccgatcgtaagaacaccgagcacaagaacaaaggtcccaatcatttcactgataagattggcaaaatagtttggaatggccggcccggtcgaaaatacgccaagtttggctcccggatcgtccgtctccttccagtgcggcaaaaagtgaaaaaatacgacggcagcgccgatcatggctccgaccatttgcgccaaaatatacccggccactttcgaccatggaaaatccccgttaaatgcaagcccgacggtaagtgcgggatttaagtgggcaccgctgtattttccgactgcataagccgccatggcgacgccaagtccccacccgaacgaaatgacaatccagccgctctggtaggcaaatgactttttcaaattgacattggcacaaacaccgccaccaaaaataatcaggatggctgtgccaaccaattctgctaaatatggattcataccccttcctccatttcgaatgaattaaaagctgatccggcaacactccggtccctttcatcaaaaaagaacaaaaagacccacgacgcccgcaaatttgttgcgaatggagtggatctctttgttctcctgccaagtttattaacttatgtatgatgataacgcttactttaaattttgtcaatccatgttcacaaaaaaatatataccggatttttccagattttgttgaaagaagcggacatccttgccagcagacttaggattccgctgggctgcattcggctccaatgggagaatgtttcacatcgcttccacttctggttaggagtcggcttgtcaatatgcccgctgtacacccgggtgccgtcccatgcaaaaaaccactgcggccgcccggaacagccgcttatctttatttcttttccaaaaaggcttcccacaattccgtgtccgaggtagtgatgccttccgctccggctttcaatgctttttccacatcttcccgcgtacggatcaacccgcctgcaaaaattggaatgccaagccgttcttttacttcggtgatcatccatggcgcgattcccggcaaaacttcaatataatcaggtttcgtccgttcaattaatttgtaacttttctcaagcgcatgcgaatcaatcaggaacattctttggatcgacacgactcccttttgctttgctttttgtatgacattggctttcgtggaaattagcccgaaaggttgatactcctggcataaatattccgttgcgtaatcatcactcttcaagccctggatcaagtccacatggtaaatcatttttttgccttccgcctttgccattgccgcgacatatttgagctgtgaaatgtgaagctccagaaaaatcccgatttcataatcactttttaaaaacctttcaaactccttcatgttgacagaagccggaagaattctttgagaaaaggccattttttctcctccttatattagtgcaaatttagtttaccacgtacgatgggccggtacgcattgtgtatatgacaagattttcccgatatgtcagatggccaaagtcatcttggaacacttccagtttctaatcataatccagctccccaaaaatccaaaatccgatacccacgaaagtcctgaaatacgttcggctatcaagagcgggctactcatacgcctaagaagagatactgcaaatacggactgatttttccttcttctaccattgaaaagcttacgagtgcaatgctttttcatgtatttttataaaatccttgtatttaatgtttaaccaatcttccagaattcttgtcaagtccaggaactttgcttaatgagcaagttctaagtatggaacaaatattttttgaaaaaacgcatttttccctttgaaaaaatttttaaaagtagtataataattgtgcaaacaaaaaattgaaaggagtttttttatgaaaaaaattttttattgtttctgagtgttttgttgattgttcctttaattcctttagtttcatcaaaagtaaaggcagatgatgatataagtagtagcaatagtagtgattctgcttctactcctcagcttattagtgttacttattatgataaaaatggaaactctacaacaacacctattgcttcttcacctacaaacccatcgggtttgggaacagtatcttatgtccaacttgtaaacggctctggtggcaattggagttggaaatataaagcgacttataaaggcgataatgtttctggtaacaaaatagctagcactttatacaaggcttttgaagcagttgtatctagttatattgctaaaagagtaggaggatggaaaggcgccgcttctgctagtttagtaaccagtgtcatgcctgtatcaaagagcaaaaattattattggactactaaaaaatatgttgacgaagataatgccgcaatatacgtaaaatggagtacaaagttgtattcaaattcttcgagaacgaagctggtaagttcatatgacgctgtgacttcgtacatgaaataaccaaggcaactgccttggttatttcatttaacaaagctaaaataaagaaaaatcaatatcaagcaaacagtaacaactttttccctggctgcaacttttttatagaattctatgataaggtgaacaaagaaataaaaggctaagatgaaaaaagaaatatggacatgatcgaaagttgcgaataaaagaaccggtagaaagatcaaaagccaaatataagtactcctccatattttaataaacttttccatacgttccccctatataaaaagtatttatgttaatgtttctgcacctcacccaaaaactcctgctaaattccctaaacagtaatgtctgtttcgtgacgccatcacacccgtaaccgatttaaagattctcaaggaccatccatttgattctcacatcatgaacattacgaaccattctgcattctggtttacttactggaaaagattacggccggctgatgcgtttggcagccggccgttgttatcctgtttcctatttcttaacgtatagcgtctcaggcactttatctaaaagcggggtcaccggaccgttgctgacaagggcgaggtggtgcatcgcccgcgtcccgactgtatatagcagggtgcgttctgcttcatccttatatacagacgccgaagcatcgagcacgatgacgctgtcaaattccagccctttcgcaagataagacgggatcaggatgatgccttccggaagatcgctgtattctttttcaataaaggtcagatccagttcttcccgcaatgtttcatacgcttcggcacactgtttccgtgacttgccgatgatcgcaacggtattgctctcttttgcgtattttttcgcaaactgtacaacttttgccaaagcttcttccttgccgcgggccaccgtaacaaccggcaaatcgccttcgcgttcaaaccattcaatcttctccccgcctgctaaaatttctttcgtaaagcgggtgatctgggcagtcgagcggtagcttttcgtcaagtatacgacctgcgctttttcttcaccgaaaatctccttgatcagctccatctgcgaacggccgcttgtgccgaatatggactggttcaagtcaccgagcatcgtaaacttgctgtacgggaacaaatagcgcaaataggcaagctggaccggcgaataatcctggatttcatcaataaacacatatttgatcgaactgctcgttgctttgcctgtcaaaaggtcaaagagatacaaaaacggcacggtatcttcatagggcagccacccttcacggaaagcggcgcgcgtttttgcatcaagccgttcttccgcaccgggaacaaattctggtgcgcgccgtaaaaaatccagatactgggcacggatatggagataatggaacgttttaatttgttttcggatcgagctgaagcggcggttgacaattttacgcgccagaaattctttctcataattggactcgctgaacgcatcattgctcttgcgcgatttgcgctcggcatattgatgggcggcaagaaaagcttccgtcccgagcagttccatttcttcttccacccatggctttttccgctcttcttttgcaatctgttccagttctttcagcagctttttgctgacaagctgaaaccggttcgacagcgagtaacttttatcataggcataaaacatctcagcaattttttcctttgccacgatcgtctcgcctttaaaacggatatcgcggaaaaggatgccgccgtttaaaagtttttccacataatcccgaacggcatggaaaaaggcaaggctgcctttgatttgtgcttctttcctattttcggctttgccttcgagcgcttcttccatttgttcgagcaggctttcgacttttagctttttgccggcacgtgcctgggcaaattccaggaaagtcgtctgctgcatattgttttccccgagctccgggagcacttttgacacataatgattaaatagctggttcggcgaaaataaaaccatttgctcggaatggagcgaatcgcggtaacggtacagcaaatacgcaatccgctgcagggcaaccgatgtttttccgcttccggcggccccttgcacgaacagaagattgctggaaacatcacggataatccggttctgttctttctgaatcgtcgccacaatatttttcatatgggtatttgcatttgctccaagcatttcctgcagcatttcatcgccaatcgaaacaccggtatcaaacatcgcttcaatatggccgcgccggattaaaaactgccgtttcaaatccatgatgccttcgcgcctgccgtccggcgcctggtacgaaaccgggccgggcactccgtcataataaatactggaaattggcgcacgccaatcgtaaacgagatactcatcctcatcccggtaggaagcaatgccgatgtaaatgggctcggaaggttccccttcttcatgaaaatcgacgcgggcaaaatatggagaataaatgaggcgatcaagttttttcacatctttttccatatgcccatagcttcgttcgcgttcagcaaggagttctgcctgctggcggacgctcgccgatgtttctacgacatcatccggctcatcgaggttcaccgttacgtcttcccagaacgtattgcggatttcctgtgcctcgccgcggacagcccttactttggagagcagtgtatccttttcgtgcttcattttttcaattgtatcatcaacgcgtttttgttcctttaaccattcttcatcgtgtggcatagaaccggccccttcctgacagtaagagtatagaaaatttttcttaaaaaaatgaacaaactatcttagctctgttgcctgctgtaaaagtagtcatcatgcaaattggcttgatgtcaaaacataagttcattttatatggcatgaagcggtataccccggcatcccaaccagtagggaaaaatgtagcaccgcaagccaataaatttgacaatgggatgaggagatgatataattaagatggtaaaatatatattccccatccgttgcactccgcatcttagtataccacgtttccgcctgattttccaatgtctggtctgttctcttttaccattccatgtttttttccgttctgttgcctgccacaaaaagtaggactcatgccgaatgggtgctcggggttgatgtaaaaacttaagttattttatagagaagaccgcataatctctcatcttgccattctttttcttcatttccctttttcaagcataaagtgatgcacgctggcaaaacctatccgtaatactgtttgttggaggttgctaacgtggaaaatccagtactgaccattgtcgttccctgttacaacgaagaggctgttttatacgaaacggaacgccagctgacggaaatggtgtattccttgatgaacgaaggcctgatcagcccgaaaagcagtattttgtttgtcgatgacggcagccgtgaccagacatggacgatgatcgaggaaattgtaaggaaaaaccggcttgtcaaaggattgaagctttcgcgcaatttcgggcaccaaaaagcgctgcttgccgggctcgaaacagcaaaagaagaggctgactgtgtcatttccatcgatgctgatttgcaggatgacatctcggttatgcgcgaatttctattgaagtttcacgacggctgtgacattgtgtacggcgtgcggaaaaagcgggagaaagataccttttttaaaagagcgactgcccaggggtattaccgggcaatgaaaaaactcggcgttgatctcgtatacaatcatgcggattaccggctgatgagtaagcgtgcgctggaggagctttcccgcttccctgagcaaaatttatttttgcgcggtgtggtgccgttaatcggcttgcaaacggccgaagtgctttacgaccggaaagaacgggcagccggcgagagcaagtatccgctcaaaaaaatgctggcgtttgcctttgacggccttacttcttttagtgtggtgccgattcactttattacccttgtcggtttgtttacttttttatcaagcaccatcgccggcttgtatgcactttttgtaaaaatttccggccatgcggatgacggctgggcttcgattatcatctccatttggtttttaggcggctttatgttaatgagtatggggttaatcggcgagtatattggtaaaatttaccaggaaacaaaaaggcgtccgcgctacacgattgcgcaggatgcacagcaggagacaatcagccagcaattgttgcggacacagcaggattcggcaaaaaggattaattgacaagcctgttgtcgctttttacgtcgtatcagaagcggtggttggcttgttccaccccgccgcttccttctatctcgcttttttgggaagccgtgttttcgtatgcggcaaagcacctcggtgaacgcgtaaacacgggcttcttttctttcaggtcattttacgaaaagagccgcgaaaaccacagaccagcctgtaaggaccggaacgaaacctaggctccctcaagtgcaaaaaagcgaaaggcacacatcatcctttcgcttttcctgcttcaaaatggaatcacgccaatcaccaatgccacaatgatcataacgagtgccgatacgcacgcccattttaagaaagcacgctgcaaatcaccaaactcggcaccgaccatgccgaccagcagataggtggatgggacgagcgggctcagcaaatggaccggaagcccgagcaatgatgccctgccaattgcctccgcgctaatgccgtacgctgccgctgcctttgcaacgagcgggagaacgccgtaataaaatgcatcattggacatgaaaaaggtaaacggtgcactgatgactgccgtgatgacagcaaaatgcgggccccaggctgctggaacgtgggtaatcaatgtgtttgccattgcatcaaccatttttgtcccggacaaaatgcctgtaaaaatcccggctgcaaaaatcattcccacaaccgacatcgcatttccggcataggctgcaaccctttctttctggacatccatattcggatagttgaccatcgccgcaatggcaaaaccgagcataaacaaaaccgctgtcggcaggacttccataatgagcccaacaagcagcgcaatcgtcaaaaggccgttgaaccaaatgagtttcgggcgctttaattcattcccctcaccgactgcaactgctgcagcctgttccaaaattgcttcattttctgagctgatgatccccagccgttttctttctttacgcccgagataaaaagcaaggagaaagacaaatagcaagccgccgatcatagacggaatcaccggcgtgaatagatctgacgtctcgaggccgagcgcactcattgccctagctgtcgggcctccccatggcagcaggttcatcacgcccgatccggaaacggcaatgcccgcaagcacgagcggtttcatgccgatccgctggtaaagcggcagcatcgcggatatggtaatcatataggtggtcgtgccgtccccgtcaagcgataccaaaacggctaaaaccgctgtcccgatcgcaattttgagcggatccccttttacgagttttaatatttgcgagatcaccgggtcaaataaccccgcgtcgatcatgagtccaaaataaagaatggcaaataaaatcataatgccggtcggcgcaacgcttgtaaccccgtcgatcgccatcttcccgattcctttccaaaacccgccgataaccgcaaaaatgatcggcaccaacatcaacgcaatcatggcggacaaacgtttcgtcatgatcaaaaacatgaaaacaataatcatcaaaaaacccatgaatgccaacaaaacagccaccccttcgttcgtttctttcagtttacccaacgaagcaaccattgtaagcgttttcaacattattgatataaaatccattttgattattttgtttattttgttcacgaacagaaaagggggaagggtgtaaaagcaacatgtgcccagtactcgctaacgaagcccggccgatctaatggtcggtgagcctcgtgcaagagcaacacgtacccagtactccccagtatcccgtcacggtcccaacacttatggaaaacccgatttccattttttgtaaccctcgttttcacaacctgccgtacaggcgtttaaacaaggtaatatttccgctccggcctgccgacgatgccgtattcgacttctgccctgcacgtccggattgaaaccaggtattccaaatagcggcgggcggttgtccgggaggcgccgattttttcggcgacctgttcggcggactgcccctggtccggaatcagcactgcttttactttgctcagcgtaatcgcatcaattcctttcggcagctccgtttcctgcgtccccgcttcccggcgtggcgacccgaacagcgaatcaacccaggcctgatccaccgtacccgctgtttccaggaggcgctttttatccagatacttttcgaccgtctccttaaactgcttaagcgaaaccggcttgattaaataatgttccaccccataatgaagcgccttttcgataaaatccttttccacagcggctgtaatcatcataatgtcgagatgcggcgacaacgcccgcaggtcaggaagcagatcaacaccgatccggtcgggaaaatatacatccagaagcaaaaaatccggagacttttcctctacaagcgccagtgtttcttttgcattcaaggctttgccaaccacttcgaaacaagggaactccgccagaaacttttcatggacaagcgccacacggaaatcatcctcggcgatcaccgcttttattgttttcaactgttgacaccctcccttttcggcaaataaaccgtaaaaaccgttccttccccggggtggctgtggacttcaataaaacctccaagttcagacacagcatgagcggcattggataagccaaaccctctgttcgcttcttttgcttttgttgtaaaacccctttcaaatatatgcccgaggaccgcttcttccatgccaggtccgttatcgctgatttcaaatacaatgtcatcccccatatctgtcgcaaaaaacaagacggccgggtgatcggtttttcccgctgcttcaaaagcattgtcgagcagattgccaagcatgacaatcagccgcatcacatcgatttgctttggcaacctttctaaagaactgttcggatcaatatcaaaatgaatctttttttcggatgctttgccgagtttgccgagcaaaaccgcctggactttcatgtcttttatcttctcaaaaacacgggcgtgctggtttttcaaagatgccgtctcttccctgataaattcaattgcgtcttcataagccccaagctgcaacagcccggaaaggacatgcagcttatttgcgtattcatgggactgggcccgcaaatcttccgagtattggcggacttcgctcaatgtattggccattcgttcaatttccgaacggtcgcgaaaagaagcaaccgccccctgcactttccctcgttcattcagaatcggagtactgtttacaatgagcgtccggtctttccataccatttcccggtccttttgcggcttgccggattttaacacggcgtaaaaaatggaagccggtatcagcttgtcaatctttgtacgcctgaccgatccgtcaatatgcagcatttttttcgctggctgattcatggtagtgacaaacccttcccggtcaacagcaataatcccttctttaaccgcatgtaaaatggcccgcttttctttgtaaagcgacgcgatttcgaacggttcaagccccattgtgtctttacggatatcccgggcaagcagcacgcttccgataatggccccgaaaaaagcgagcagtgcgacgccagccactttcatcatgtgcatgttggtctgccgattcacatcacttaacatgaacccgaccgacacgatgccaataatgtttccgttccggtcgcgtaccggtgttttccctcttaatgacgggccaagtgatccttttgcgcttgagatataggattcccctttcaaaatggcccgttcattgtcaccgccaaccatctttttgccaatccggtccgggagcggatgggagtagcggatcccttccctgttgccgacaacgataaactcggcgccggtttctttgcggattttttccgcaagcggctgaatcgttttggacggatctttgctttggaaagcattcacaacagccggcattgccgccaccgttttcgcaatatttaacgccaggcgcccttcctgttgttcgattcggcgctgctccagcaccataaaataaccggaaatcgtgccgatgatcaaaaaagacagaagcagcacaagccccagtatttttgtctgcaatgaaacctttcttttacgcatccccatcccccgccaaaaaggatttatcttcattttacatgatttttggaaatgttgcggcgaaaatggcatgatgcgctaaaccgcgttcccaatctaagcaaaataaaagccgccgggattgtcccggcagcctggaaaggggctggtatttcttctattattttgctgcagcctgttcgtaaaccgcatcttcgtacggctggccgtaagcatgttcgccgtgcaacgtaatatcaagacctcttttttccgcttcttcatcaacacggatcggcataaacaattggatcgctttgatgataataaaggaggcaataccaacgaaaatataggtggacacaatggcgacgagctgtttccagacgagcgacggatcaccgtagaacaaaccgttcgcgccagcagaattgaccgctttagaggcgaacaggccggttgcaatgccgccccatgtgccaccgatgccgtgaatgccgaatgcatccagcgtatcatcatagccgagtttcgatttcaaatacgtgacgccccagaagcagacgatgccgccaaccaggccgatcaggatcgaagccattggcgttacaaacccggctgccggcgtgatcgctacaagccctgcaatgccgcccgagatcgcgcctgacaatgtcggctttttattgacaatccattccaccgcggcccagccgattaacccgcaagccgccgcagtattggtattgatgaaagcatacatggcaacttcatttaacgataaggcacttccgacgttaaatccgaaccacccgagccaaaggagactgccgccgatcaggacaagcattaagttatgccgtccggtctcggattctttccgttttccgagcacaagcgcgaggatgagggccgccacgccggaagaaatatgaaccacattgccgcctgcaaagtcgagtgcgccaaggttgcggatccagccgccaacgccccatacccagtgggcaacaggcgcatagacgagcacgcaccataaggaaatgaaaatcaagtatgccgaaaaccgcatccgtccgacaaaaccgcctgaaataatggcaatggttaaaaccgcaaacgtcatttggaacatcatgaataagttatgcggaatcgtcgcactgtaatctgcattcggtttaaacgtgacatcgtgcaaccccgcccagcttaaatcgccgagaatcgcgttgccgccggttgaaaacgccagcgaataaccaacaagaatccataataccgatacaatcccaagcgaaccgaagctgtacatcgcggtgcttaaaacgtttttgcttttcaccatccccccgtaaaacagcgcaatcgcaggtgtcatgacccaaacaagcgccgtcgatacaaacataaagaccgaatctgcaggaaccatttgcctcttcctttctgatgttagattttataacgcatctttgttatataaattatcatatgtgatgtcagccattttttcaatactttttcgttaatttttttaaaatttttatatttgttgtcaggttttcttacataccgatcagaacgcgctttcaaattttaaacgaaaaggactgttttcctcatgcaagcttttaaaatgattggcgcatcctaaaatgtggtacaatctgtctgtaaaactccaaagaaagaagggaattggatgaacccgtttacgttttacaacccgactgaactgattttcggaaaagggcagctcgaaaagctcgatgaaaaaatcgaccagctcggaaaacggatcttgcttgtatatggcggcggcagcatcaaacgttccggcttgtatgacaaattgcaggcaatttttgagaagaaaggctgccatgtgcgcgaacttgcgggcgttgaaccgaatccgcgcctgtccaccgttaaaaaaggcatctccctgatccgcgaaaatgaactcgactggattcttgctgtcggcggcggcagcgtcatcgactgttcgaaagcaatcgcaggcggtgccctgtatgacggcgatgtatgggatttttacgaaagaaaggcgaaagtggaaaaagcgctgccgcttggcactgtgctgacgctggctgcgacgggttcagagatgaataaaggctcggtgattacgaactgggaaacgcaacaaaaacacggagcaagcatgactttcccgacgttctcgattttagacccggaaaatacgtttaccgtgccgcgtaaccagactgtttacggcatttcggatacgctctcgcacgtatttgagcaatatttttcgcatacaaaagaaattccgctgcaaaccggttttgcagaaacgattatgaaaacagtgatcgaaaatgcgcgtaaagtgctgcaaaaccttgaggactatgatgcgcgcgcaaacttaatgctgagctccacttttgcgctcaacggcctgcttgcgaccggcgtggaaaccgactgggcaacgcactcgatcgagcacgccgtcagcgctgtttacgatatcccgcacggcggcgggcttgcgatcatcttcccgaactggatgaagtacgtctataaagaaaatatcccgcgtttcaaacggtttgccgttgaggtatggggcgtggatcctgcagggaaaacggatgaggaaattgcacttgctggcattgatgcagtccgcgctttctttaacgaaatcggcgcgccaagccggcttgcagattacaatatcggcgatgacaagctcgacgtcatggcagaaaaagctttgccattcggcccgatcggcaactttaaaaaactgggcaaggaagatgtgcgggaaattttgaagatgagtttgtaaaaagaaaaggatgtcctttatagggcatccttttctttttgatgggagcctgcgaaatgagaggattaaaacccgcctccgcttccgaaccatctgaccatagcgtcggcccgttggaaaccggtacatgaatggagaatgcgaaacgggggttgaacccgtctccgtacgaatcatctcgcaatagcggcggcccattggaaactggcacaagaatcgaaatggggttacaacccgcccccacttctgaatcatctggccatagtgtcaatccattggaaaccggtacatgaatggagaatgcgaaacgggggttgaacccgtctccgtacgaatcatctcgcaatagcggcggcccattggaaactggcacaagaatcgaaatgaggttacaacccgcctccacttgaatcaactggtcatagtggcggaccgttggaaaccggccaagaaaggaacctaagaaatgggggttacaatccgcctccacttctgaatcatctcgcaatagaggtggccgggtgactagcctaagcaaaggaaccccgtcaggaagcagtcttcccaacgggttgcagttactccaacacttctttatatactttattttcccgcatcaaaaccgggtataaaaccaggccgatgacaaacagcccgatgccgaggaagaacgtttttaaatcggcagtgccggtaatgataacccataccgaatacactagcgcaataccggtaatgataccgtctgttgtgcgagcgcctagcgacgtataagtttcaccggctgccaccagcttcaactggtaaataaccgatacaagatacggaatcaaataggccagtgttgccacgacaatggcaaaatcgtacgcttccgaaatggtgtccgacacagtggagaataaaaagatttgcgtcatgatattcgttaccaatagcgaacgggacggtgatccttttctgttcgttttcccgaaaaatgccggaaaaaggccggcctttgccgcctggtatggcacttcggagctgacgataatccagccgacagttgaaccaaacaaggaaatgagcgccagtgcggctaatatatactggccgtttgcaccgagcacctgaccgagcgcatcgacaagcggtttatgtgaaacgcgcagttccgcctgggacaaagcgcccattgtcagtagtgtaatgccgacataaatcaggatcgagatcaacaggccgagaagtgttgcctttttcacatctttttgtgatttggcgcggtttgacagcatcactgccgattctatgccgataaacgcccacaatgtggagatggcgccgccgttaatttgcccgaagagagaaacggcgtggccgtccgcatcggtaaaagctttcgcattgccgaagttcgcggcatcgaatgcaaaaacggtaatgacgataaacatcataaagccgagtacttttgtgaccgtcgcgataagattcatttttccgccactgttaaagctatgcgacaggatcgattgaatcccccaaagcatgactgtacacacagcaaatgtcaaaaattttccggtctccatttggaaagatccgagcgtaaacaggattttcgtgctttgcataatcgggaaaaatgtcgttaaataacccgcaaacgaaataatgacggaagccgttgccgcccagttcgctgcccagtagccccatgccatgctgtagccggcgacccggcctgcctgtttcgatttaaaaagcgactgtgcgtagctttgcggtcctgctttcagttccggtttccggatggccaggtttccgaacacgagcgcaatcatcaaaacgccaaaaccggtcagcacccacgcaagtgtagaaccgagcgccccggccttatttgcgagattagccggcagcatgaagaccccgccgcccaccatattaccgacgacgaacgtggttaatgtccaaagtccccattttttattcatatatgttcaccctctgtgttgttctcggtaaaatttatgactttattttagcgtgtttctttagtttagtaaagtggtaaattagtaattcgttaaaataaattttggaatagattttctggaaatgggaaacccgattgcatcaagcaatcgggtttccgatggatcaaatttttaatggaaaatactttcttccttccgtggtcacgatctgccgcactgagcatcggttttctttcgtaaaggtgaccagagaaccgttcaggtcctcttctaccgctgtaattcgaaatccgcaatccagcagacggtcaatctccgctttttctttcaggaataaaatggattcgcgcatcattttttccttttacactgtggctgctgtcggggactgcagagcaccctggttaatttttttgcgtttcaaatatttcccacttcccggctggccaataaattttttgtctttgatgacaaaattgccacggcataaaacagagattggctctcctgtgatttccatgccttcaaacgcgctgtaatccacgttcatatgatgggtttttgcagaaattacgcgctttacttccggatcaaaaataacgagatctgcgtccgccccgacagctattgttcctttttccgggaacaggccgaacagtttcgccggttgggtggaaacaatgtccacaaactggttcaaggataagatcccctttttcacgccttctgaaaaaaaaatactgaaccggtcttcgataaacgggccgccgttcgggattttagaaaagtcattgcgtccgagctgtttttttccgttaaagttaaaagagcattgatccgagccaagggtttgcaaaatgccggcctttaaagcgtcaaacagcactttctggtgatgcttttcgcggagcggcggcgaccagacgtatttggcgccttcaaaatccggtttttccaaataagactggtcaagcacaaggtattgcgggcatgtttctccccatactttgtatcctttggcgcgtgcttcggcgatttgcttgacggcttcggcacaggtgacatggacgacatacagctgggaatccgccatgtgggccagctcgattgcccggtgtgtcgcttccccttccgcttcgggaggcctggttaaagcatggtaaatcggttccgtgtgtccctctgcaagcgcctttgtaaccagttcgtcaatgacgctcccattttcgcagtggaccattacgagcgcgcctgcttcttttgcggctttaaatgcgcggaacagggtgcggtcatcagcttggaattcttttgcgtatgccataaaaactttcagcgaggtgattccttctttttccagtaagagtggcaattcttccagcaccttttcatccagattggcaagcatcaaatggaaaccataatcaatggcagctttgccctccgctttgccatgccagcgcgcaacggctttttccaacgtatcatcccctgttgtaaggcagaaatcaatgatcgtggtggtgccgccgaatgctgcggcaattgtgccggtttcccagtcatcatcggttaccgtattgttgaacggcatgtctaggtgtgtatgcggatcgaccccgcccggaaaaatataagccccctttgcatctatgatttctgcatcatctgctgtgagattgcgtcctatttctataattttctccccatcaaccagcaaatcagcttcataagtgtccgctgcggttacaacaattccatttttaataagttttttcatgtatttccctccatttaactgattgtgatttcgtcggcttcaagaccggatatttttcgctggcgttcattccaggtaagcggcatttcccctcgtaacggtatcattgtgatggcgccgtccgctgggcagacaagcgagcaaagattgcagccgacgcagtcttcttcgcgcacccttaaaatgctttttccggaagtatccaccagcctgtcaatacactggtgagccgtatcctcacaagcgatatagcacttattgcaatgaatgcaatgctcctcgttaatgcgggcgactgtcctgtaattaaggtcgagttctccccagtttttgtatttcggtacggattttccaataaggtccgaagctgattgcaaccctttttcatccaaataatggttcaatccgtcaatcatatcctccacgattgagaatccgtggtgcatgacggctgtgcaaacttggacattggaggcgcccatcagcataaattcagctgcgtctttccaggtggcgatccctccgattccggaaatcgggacggggatgtcagggttgcgggcacattctgccaccatacttaatgcgatcggcttcacggccgggccgcagtagccgccgtgtgtgccaaggcctgctacgtgggggacggtctgccaggtatcgaggtccacccccatcaggctgttaatcgtattgatcatactgacggcatcggctccaccctgtacagcagcgaaggcagtggctgtaatatccgttatattcggagtcagttttacaatcaccggggtttttgcggcttccttgacccagtaagtctgctgttcaaccagctgcgggacctggccggatgccgcacccatcccgcgctccgccatgccgtgcgggcagccaaaatttaattcgagtccatcaacaccggcatcctccacccttttgacaatttcatgccatttttcccgttttggctccaccatcaccgaggcaataattgctcgatcagaaaatttctttttcgtttcagtaatttctttcaggtttacatccagcggccggtctgtaatcagttcaatattattgaaaccggccattcttcttccgctataggaaagtgcggcgaaccgggacgtgacatttaaaatcggatcgccgagcgttttccaaaccaccccgccccatccggcttcaaatgcacgctgtacctggtagccggaattggtcggcggcgccgatgccagccagaaaggattgggcgaacggatgccggtaatctcaacgtttaaatttgccaaaaactaaacctcctctctcatgtaacgcgtctgcatggcgcgttgaatggcatatgctgccttctttccctgttcaaccgcactgactaccatcgcttccgtggggccgatgccaaaaataacgtctccggccgcataaattttttcattggaagtttgataagtttccggatccactgcaagaataccatggtgatgcacaaggccgaatgcattgattagatcagtacggcggttttggccaatcgcccggaccaccacgtctgtttctagcctaaatttcggatcttctgttgcctggatcttgcgttttccagaggcatcaggtgcgccaagcacgacccggctcaaagaaagcgccgtaacattgccggatacatcgctgatgatttctgcgggctgccactgccatctgaattcaattccctcccgcttcgcaaattcgtattcacttttgtaagccgtcatttccgcttcggttctgcggtagacaatttttacatccgccgcccccgcgcgcttcaggcaggtggcagcatcgatcgctgtattcccggcaccgatgacaaccgcccttttgcccttaaattcattcgttatcctgccttctttgatattctcgatcaattcaattgcatccaaaacgccgttgtactcctctccggggatgccgaggcgcggaacatttcccattccgcatgcaactagcacggcatcatagcgggagaggatttcctccgctgaaatgtcttcgccgacccttatttctgtcaaaatctccacgcccaaagctgtcacttggtccgcttcccagagcggaatttcctggggaaggcggaacgggacaatcccgtatgtatcgagtccgcccgctttttcctttgcttcataaacagtgacgccaaagccgtacctcgccagttccctagccgcggataaaccggctgggccgctgccgataatggcaaccttcatgccgtttgacgtgcgtttttcaaaaagagtctccccggactgcatcgcccagttaacggcatgccgctgcaaatcgccaatcataatcggcagggaaagctcgttcagcacgcatgccccttcgcacaattcttcggtagggcagacgcgggcacaggtcgcccccatcggattggcttccagaatcgcacgcgcggaacctttcaaattgcccgtggcgattttccggataaaagaaggaacgggaatgccggtcgggcaggctttcgtacatggcgcatcataacagtataaacaacggtttgcttcttccactgcttcctgtgcggataaatctcgccgaacttctttaaacacggctgagaccgtcaaagattccattcaaacaccccctgcaagttatatttgattgctttgttccgcaacggttgcggtcaccgcaccgcctttttcatgacggctgacaaaaacggtgatgtcttcatatgctttctgggacaacaaactcctgtcattgcgcatcagccagctgtaggcaacagcggcaactaagattccgactgtccacgcattgtcccacaaaaatctaaggcccgggacaagaagccccacaaccggaaccgcaatgccgatcacaagcgcaaataccccgctcgtattaattccggaagaatagttgtagcgcccgttcgtctcatacagttcttttaggtcaaacctccggcgccttacaatccagtaatcggcgatcgcaataccgtcaatcgggccgaggagcgcaccgtatgtgccaagaaaaccgtaaatcagattttgaaagtttgacatgaggtaccatggctgcatggcaatggcaaaaaggcctgtcacaattgcgcccgacgcaaatgtcaggcgccgcggccataaattttcaactgcccgggccggggccaccaggttcgcgccgacattgaccgtaatggatgaaatggcgacaacaatggccccgataaaaacgacaagagtcgggaattttgaaagcagatcaaccggctgccaaagtgcctgaccaaaaatcacaacggtggcggaagtgacgaaaatgccgataaaagagaatattgtcatcgtcagcggcagcgcaaacgactgggaaatcatcatcgatttttggttcaccgcatggcgggcaaaatcgggaatattaagcgcaagcgttgcccaaaaggctatgacgccggtcagtgccgggaagaacaccgcgagaaattcgcctgtcgtctggaacttgctcggcgctgtgagtattggcccccagccattgacatgggtggccgcccagataaataaaattatggacgagaccccaaccaccggtgtagaaatggtggcaagccatttaatcgcttcaggccctttgatcccaatgccaacatttaacgcccagaaaagcagaaatacaattccggtatgaaaaggcaggccggaccagcccgagaccatgcgcgacatcaaggcgtcaatacttgtcgtgccgatccaggtattaatcccgaaccaaccggctgccacgatcgcacgagccaaagtcggaatatgtgcgccttttgatccgaaccagagccttgcaaataccggataaggaatcccaaattttgcaccggcatgcgcatttaacaaaatcgggaccagcacaacgcagtttccaagaaaaatggtcagaagtgcctgccaccagttcatcccaagcgagatcatgccgcttgccattgtataggaaggaatgatcaggcacatgccgatccataaagctgcaaaactccttcctgtccaggtatgctcttcttttgttgcagggcgcaggtcatcattccagaggtttgagtgctgcaattgttctgccgtttccttcgtcaggatgacaataccgttttcttcaatttgtgatttcatccgttcccctccgttttcatttgctgttattgccctgtaagcaaagacaacacggtatccagtgccacgtttgcgccgcgcgcgcagtcttcatatgacgtcagttcttcctcacagtggcttttgccacctgcactcggtacaaaaatcatcgcggttggcaggtagcttgcaataaattgcgcatcatggccagcgccgctgtacattcttttggcggaaatcccaagcgactgagccgatttttcaagccggctgacaatgccctgatcaaatgcaacggtatcacgggaccataatttttttgaagcaatcgtgcatccgcccatttcctgcggtaacgtcctgattgtactcaccacctgcgacactacttgaggatctttgtgccttgcttcaagtgtgaacaccactttattcggaatgacggtatggatattcggatacacattcatccgccccatcgtataaacaagttccgggtcaagcatactcaattgttcacgaacatccctgatgatgtcacaagcaacgaacaatgcatccctcctcatgcccatcggcgtcgtgccagcatggttggattcgccagtgacttcaatttcataattgaccatgccgacgaccccttcgacaattccgatttgtttgtcttcactttccaggaccggaccttgctcgatatgcatttcaagaaaggcggctgctttcttcaggcggttttcaacgctgccggcataaccgctcgccgaaagcgcctctccgaatgtcatccccgtctcatcccggctttgaagaacggtttgcttatcaaatttgcccgaaatgacccccgagcacatcatcgccggctcaaatcttgccccttcttcatttgtaaaattgacgatggtaaaagggatttccaatttgatccggttgtcatgaatcgtgcgagccacttccaatgccgccgcgacaccaagaacgccatcaaagcgtccgcccttcttgacggaatcgagatgggagcccatcaccacaggcggcttgccttctttgccgggcattgtagcatacatgtttgccatgtcatcgtatttcacttccatcccgatttccttacagcaagtttccaagtactcccttgctgtaagatcttcctgcgacaatgataaccgtgtaaccccgttattcggcgtccgcccgaatgacgcaaacttttccagcgtttcctgtaacctttgtgcattaaccagcattttttgttgctgcatgcctttctcctccttttgttgaatatcactgaaaaaacaaaatcactatttttattgttttaatgtttatttttaagctaattttcagtttatttttttgtgaaaaaatctactgttcaccgctaatgaacgccgaagcttttatcaagccagtttaacttttccgcctgcgagccggctgtacataactttcaatttgtcttttgttatattcactgggctattctgcatatttggtgcaaagctcgctgcgacaagccggtccagatctgcttccgtttcaatacctgcttcctcaagcgtcgtgataagccccatttcttttttcatttcatcaatacgaccggcaagcgcgtccgcatctttgaacccgaggcagcggctgaacgcttcaaggcgcccgctttccggtccttccacactgttcaaacgccagaacgacggcagggtaaaagcgcaggcttccccgtgcgcaatgccgaattcctgagtcagcgggtaagagcaggcatgggcggcggccgtctgcgtcatgttaaaagcaagcccggctgtgacggatgcctcactcatttttgcccgcgcctgcagatttccaggttcatggtaagccgggagcaggtattcaaacacgagcgctgcagcccgttcagccgccatatctgtataaggctggtgctttttcccataataggcttcaagggaatgtgcaagcacatcaagcccgcttgacgctgtaacatgtttcgggcacgagagcgtcaattcaggatccacgagagcatacgcggggtaaaggaaatcacttgaaatcagcgccttaatgccttttttggtatcggtcaggaccgacacattggtcacttcgctcgcagtccctgaagttgtgggaatggcgatcagcggaatgcccggttgcacaagcgtttgtgcttttgccagaaacgcagacgcgctgtatggcgtctgcgcgatgcaggcagcagctttcgcgcaatcgaggacactgcctcccccgatggcaaccgcgaaatctgctccttcttcacgcagcatccgcgcgcaatcatccgtgttttttacggtcggattttgctgaatacttgaaaacaccgccgtaagcgcaccaccagcttctttcatgatatcctgcgcaattccctgtctgagcatcgacggggcgctgattaaaatgcccttttttccgcctgtctgtttgatgatttcaggtagcttcctgatcttgccggccccgaaatcaatcgggacgggctgtttataaaaaaagtcctccatttcaacaatcccttacctttccgcagttcaccggccggcgccaatgaagtttttgaaaaactttctatcccaacaatgcttttcctcattttaccgttaaagtatttgcaggaaacaatacgttctcttcaaactcgcgaagggccgtttcaaacaagttcatcgcttcattcacctgttcggctgtaatgatcagcggcggggcaataatcacacttgactcatgcgaataggtataaaaacctttttctgcaagcagcgctacaaatttcttcataaggccggacggatcttttccgtaatccatgccatatgcctgaagcggttccttcgtttccttatcttttacgagctcgactgcggcaaagaggccgatcgagcggacatctccgactgcgcgaaattttttcaactgtttgagccgttctgccagcacacccccggtttcgcgggcattttcaagcagattctcttcctggtaaatgtccatcgaggcacagccaatttgagctgaaaccgtgtgaccgctgtaggtcaggccagtcagaaaaatatgctcatcgaagtattccgctacgtcccggctgagaatgacaccgccaagcgggctgtatccgcttgtcactccttttgcgaaagtaatcatatctggttcaaaaggatagtgctggacagcaaacattttgcccgtccgaccaaagccggtcatcacttcgtcgcagatcatcaggattccgtagcggctgcacaattcgcgcacgccttcaagatatcctttcggcgggatgaggacgccatttgagcccggaaccggctcaaggaaaacagcggcaatctgatcaggcccttcatagaggatctggctgtgcagacggttaaggtaaaaagcggacgccgcttcctcactttcaaaatccagcgtttcgcggtacagatagggtgtttcaaattttacaaaaccggggatccctggttccacgagaaagcgccgcgattcccctgtcaggttgccggctccaaatgtcgcgccatggtaggaacgatagcgcgaaaaaattttataacgcccggtggccatccgcgcaattttcacagcatggtcattggcgtccgcacccccatttgtaaaaaatactttggccatgttttccggtgccgccttaacaattttgcgggcaagttgagattttggcgcggtggcaaacgccggcgcggcgagcggaatttccccgaccgatttaaacgcctccaacaattttgggtgccggtgcccgacattcaaataaacaagctgggagcacatgtcatagcacttatgatccctttcatcccagaaaaaaatgccttttgctttcgtgattaccgttggccgcacatacgcctgtttcgcccacgagtgcatgacatactgccgatcgtcttgctggatttgcgtaatctccgcttcattcatgattgacagctccatttctattttgtaaatgataacctcattataaaaaggtttttttcagaatgtaatgatgattggaacaaattattttgtgcggttgcacatactcattggagaatgtcttcaatcatgaacgcaagcgaaagattggtctttgtaaaactgcgggtcaggtctgcatccagtatcgtttctatttttttcgccttatacagcacggtgttgcggtgaataaattcgcggcggctgatcgcagcagtctggccgtcttcttccaaataaattttcaggaaatggacataatctgtgccgtgcaactcatcgtagcggtacaagttgccaagcatatccccgtggaaccctgcaatcctttcgcgatccttgacttccattagaattttataggcgccgatttccttgtatttgcaaataggcggtacagcttggcgcttggcaagctggatgaccatttttgcttcgtggtagcttttatggatcccggcaatatcccggtaaaaatttcccatccccacaagcaggctttccatattccgtttataaatggattcctgaatttttgccgctgcccttgcaaacgggatatctggcgtccgcacttttgaacggtcgacaaggtaaataatctggtcttcataaacgccggccagatactgcgcataacgggcatggaaaacatcttccaccgtttgtgcaaacggcaacatatcaggcttttccgtgtcctgggtacaaacgatgatgccgtaatctgcatcttccccaaaaccgagtttgaacagcccgttccgcatatacgcccggtccatccccgggttaaaaaggagttccgcaagtatttgctgggaaagcgcttctttaccttgctcaatcatcaaaaattggacggtaatttttataaaatctgctacccggtaatcccatggcatttgaaaaaccggaaaatgttgtgaatcggcaaaccggatgaccgcctctggaatttcaggaatatacgggcccgtgttaatgacaatcccggctgcgcgccgaccgcaggcaaacgccaccatctcctccaatttttcaggatcattgcccatggtgaccccagtggtgacaagtagttcgttcggcttaaaaaaatccgcccaatcaacgctctccgtcacattgacccccgtaaccgcccggctgattcctgactttccggcggcaagcacaatccggccaaacgcaggcaattcgacaagtttttccaaagtgaccaaatcatcatcccctttccaaacatgttcatatatttatatcgtaaagagacaaggataaaatgtaaataagtatctaaaatttttgaattatttacaggaaggcagcatcttttccgttaagagaactgttcggcttgactaaaaaggctgggctctccagaaaggtcactaaagatagaaaaagcggtaaatcaggtgttttatttgtatctttccattaaaataaacatatagaatggaattaactttttgattccggaatggaaaccaatcagaactgccgtttcgtagggcaaaagttttaaaacctatatttctttcattgccaagttttcactataaggagtataataactgtaatccggtcatctgatgattgacctaatactttaagaaggtgaatattgtgagagtgagtttgttcatcacttgccttgtcgacatgttcaaagcggatgtcgggaaagcaatggtggaagtgctggagcggcagggctgtgaagttgatcttccaaaaggccagatttgctgcgggcagccgtcctataacagcggttatctggaagatacaaaacctgcgatgaaacaaatgatgaaagcgtttgaaaacgcagattacgttgtatccccttccggctcatgcgcatacatgtttaaagaatacccggaaatttttgcaggcgacccggtgtgggaaccaaaagcaaaagcgctcgctgcgaaaacatacgaatttacacaatttctcgtggatgtattaaaagtggaagacgtcggggcaagcctgcacgtaaaggccacctaccatccatcatgccatatgacgcgcctgctcggagtaaaagacgcgcctatgaaactgttaaaacatgtggacggccttgaatttgtgccactacctaatgcattgtcatgctgcggatttggcggcacgttctccgtgaaaatgagcgaaatctccgagcaaatggtggacgaaaaagtggagcacgtcgaagaaaccggtgccgacgttttaatcggcggcgactgcggctgtttaatgaatattggcggccggatgacgcgtaaaggaaaaccgatgaaaattatgcatattgcagaagttttgaacagcagagattaaaaaacggcaaaggggtgaaaaaaatgggtttatcgattagtgatgaaaaatttaaaggcagggtcgaagaaggcatcaacgatgattttatgcgcggtgccgtccgcagtgcccaggaacggctgcaaaccaaccggctggcggcggcgaatgaactcggaaactgggaagactggcgttcgctcggcgaagaaatccgccagcacgttttaaacaatctggactattatctttatcaattaagcgaaaatgtatcaaaacgcggcggccatgtcttctttgcccagaccgctgaagaagcgagccggtatattaaagaagtcgtgcagaaaaaaaacgcgaaaaaagtgattaaatcgaaatcgatggtgacggaagaaatcggcatgaatgaagccctgatggaagcgggcagcactgttgttgagtccgacctcggcgagtacattttacaggtggccggcgaccatccttcccatatcgtcgcgccggctttgcataaaaacaaagatcaaatccgcgacgtgtttcgcgaccgtctcggctataccggcacggaaaaaccggaggaactggccgcgtttgcacgtaaagttttgcgcgaagaatttttatcggcggaaattgggattaccggctgtaactttgccattgccgaaagcggttcggtcggccttgtcacaaatgaagggaatgccgacatggtcacaaccctcccgaaaacacagatcgctgtgatggggatggaacggcttgtcccgacttacgaagagttcgaagttttggtgagcctgttaacgaggagcgcggtcggtcagcggctgacgagctatattacaactgtgaccggcccgaaagaagcaggcgaagtcgacgggccggaagaattccacctcgtgattgtcgacaacgggcgttccgatattctcgggacggaattccaacaggtgctgcagtgcatccgctgtgcagcctgcatcaatgtatgcccggtttaccggaatatcggcggccattcgtacggctccatttacccaggaccgatcggcgcggtattaagcccacttttaggcggatacgacaaatacaaagaactcccgtacgcctcttcgctttgcggagcctgcacagaagcctgcccggtgaaaattccgctgcatgagcttttgattaagcaccgccaagtgatcgcggaaaaagaaaaacgctcaccggtagcagaacggctgttgatgaaagcgttcggcgtcggcgcttcaaaacctggactttacggggccggggcaaaaatggcttccaaagtcgtccgtccgtttttaaaagacgatttgatccataaaggaccggggccgatgaaaccgtggacggatgtgcgcgatttccctgcgccgaacaaagaacctttccgtgactggtttgaaaagcgggagaaagacagggggcagaaaaaatgaacggagccatccaaaaccgggatgcatttttaaataatattgccggcaggctcggccgcaaaccggttgtatccggcgttgcccgtccggattacaagcataagccgcaatatgatgtactgccaaatgcaaaccaggaggaactgctggaagtattgcgccagcagtcgctcagtgtccatgttgatttttttgaaacggatgcaaaaactttgcccggaaaattaaacgaagtcgtagaactgtacggcggcgggcctgtctcgctttggaatgacaagcggttcggggaattcggcttaaccccgctgattgaggaaggctggccggaaatgggaatcgaaacccatgtctgggatcccgaaatcggcgaaaaaaatattgcgctgtgcgaaaaagcgaatgtcgggattacgttcagtgatatcacattggcggaatccggcacagtggttttgttcagcagcaaagaacgcggccggtcggtcagcctgctgccgaagacgtatatcgcgattgtaccgaaaagcacgattgtcccgcgcatgacgcaggccgccttacagatccgcgaaaagatcaaaaacggggaaaccgtcccgtcatgcatcaattttattaccggcccaagcaactctgctgacattgaaatgaacttgatcgtcggcgtgcacgggccagtcaaagcggcttacattgttgtgaacgacaaataataaaacgcaaaaaattcaaaaaatagatgacctgttgaaacaggccatctatttttggttttacgctgtttttttcgcttcttgttgcagctcactgtggcggatgctgtatccgaagtagatcaccatgccgattgcgaaccagacaacgaagcggatcagggttgccggctgtaggcttgcgatcaatatgccgcaagtaattgcaccgagagccggtataaccggggcaagcggtgttttaaacggacgttccagatccgggcgtttatagcggagcacaatgactgccacgcatacaatcacaaatgcagcaagcgtcccaatattggtcatctcagccacaatattgatcgggaggaacccggctgtgatcgcggtgacgattccgaccaaaacagttgaagtcgctggagtttttctcttttcactgacttttgaaaaaattttaggcaaaagtccgtcacgcgacatggcaaacaatacacgcgtctgcccgtatgccataacaaccaatacggaagtaatcccgcaaatggccccaacggaaaccagtgccgcaccccagtgaatgccaatttgctgcaatgcatacgcaacgggagcagaagcagcttccggcctgctgaaaatgctgaatttgacaacgcctgtcaaaatggcggaaacgatgatatacaacacggtacaaattaacaaggagaacaaaattccgcgcggcacgtctttttgcgggcggcgcgtttcttctgcagctgtcgatacagcatcaaagccgatgtaagcaaagaaaataaccgctgcgcccgaaagcacgcctttaaatccgaacggcataaacggatgccagttgaccggtttcacatgtgcgacagcaagcaccacaaacagcaggacaacggctacttttatggctacgatgatgccgttcaggcgagatgtctgctggacccctgaatacaacagccaggcaactagagcgataatgagaatggccggcaggttgacaatgccaccgtccatcggtgcaagcgtcagcgcttttggcagatgaactccgagatttccaagcaagttcacggcgtatccggaccagccgatcgcaacggttgaaacagccaggccgtattccaaaatcaaatcccagccgataatccatgcccaaaattcacccagcgccgcatacccgtaagtataagcacttccggcaaccggcaccattgatgcaaattctgcataacacaaggcagcaaatccacatgcgagccccgacaggataaaggaaataacgagtgcagggccggaatagtttgctgcagccacacctgtcagcacgaatatccctgtgccgataatggcgccgatcccgagcaaagtgagatcgagtgcaccaagcgcttttttcagcccttgcttgccctgggtcccttctacaaggtttgcgattgcttttgtctgaaagatgctcatttctcatcctccccaagaatttttggataattgcataattctattatacttttcattgaaaatttatcaatatagaaatataacaaattaagaaaaaatttggattgtaagaaattgtaactcttatcgttcttttccatccttcccggatatgcctgcatctgcttggcggctgcagaaactgttttgtttgcttcgtcatggaacacggcagagtaaaaatttgcacatgaaatagggcttgctgaataagcaaaacctacagaatcggcaagggatgctgaggattttgtgaaactttaaatgcaaaatataggaaaactttgtgattgaaagctgtttcaatgattagaatatgttaagattgaccttcgtttttcgcgctttcttaacttagatgggttctatgtgaagaaaggccgtcttttttccacgcttccttcacttagacgggctctacgtgaaggaagaccttcttttttcctcgcttccttaacttagacgggctctatgttaagaagggcctttatttttgcttgcttccttaacttagacgggctctacgtgaaggaagacctccttttttctgcgcttccttcactcagacaggctctatgttaaggaagacctccttttttcgcacttccttaacatagacgagctctacgttaagaaagacctccttttttcctcgcttccttaacttagacgtgttctatgtaaagtcaccatcaggcggattgcgcagcttctgccatcatttgcgggtgaacaatgcagctgaatgcatcatccccggataaacattgtgccgaaaaagaaatcagcactttttttacaggccatgtccggtttccgctcgtcagttgtacctcatccggcttgtacgctaaaagaagcgattgtttcccgactgtttttgccgggatgaaccggacgcggccggcccattcgtcaggaagtgtagcacttccgtccaaaagacgggtcgcatcttccgcaagcaccgcaatttcttcggggagatgctcacggacgggcaggatggaaaggatcatcactggcagctttgtcagcggatcatataactggttgccgctatccaccagcccttttactgtaaaatcactttccccgatgcgaatataaacatcgacaagctggtcatacttgattttcgccatttcaagcccctgaatccggttctttgaaaacagccatgccgccggaagaccgagcgcaacaaacgcccagctgaccgggtcgccaaatccccccgccgcagctttaagcattttcacctgcatgtcgaagtgaaagcttaaaaagtagtgggcccccattaaaatgccgcccatcagaaacgtggcaaaataaaaggttaggagatttgaaaaaaaatagcgccaccgcttatagccgaaaactgcaaataccatgatgccggaaaaaagcagctttacaaccgggttaccggcataataagaaagctgcggcataaagcccatgatgatgatcgctgaaccgatgagcccgcctgcaagaatccggagcaggcgggccggccgttttaaggcaatgcttgtcagccacaacagcaggctgtcggcaagaaaattcaaaagccagatggcatccatatatacaaccaaacgcatcccccctgtctccgcctcaaatgaatccgcagccgtcccgccaaaacggccgcttttgcccgggccgcgtgcccgaggctgcggaatgcttgccgcaatgcatcctgtgccggttttcgtatactaacccggtaacgttgttgaaaggtacatcgactaaggctttacccggtgattgttgctgaaaggtgcatctgctgcggctttaagaacgccaatccggtgaatgaacatagtgcaaaccaatttccggcttccaggcgaactcttttgccgattgctgcttctgtccttttgattagatttatggctagtataacgcacgcggagcattaaagtgtgtcagtttctgctggcaaaaaaacagaacttttcatttttttagccgaaaagtgtcaagcatgcttgctcgattctgttgtcacaccgatatgcatccgaaaaaaaccccgactggatatacagacaacatctcgcaaattcaaaacaacttagcaacataaacatagctgcggtgctctcaatatgcagacgacatctcgccaatccaaaacgggtttaaaaagtgttttcaaacgcaaaaaagcccgtctttgctttcagacaatggcctggaaagcagagacgggctctttcattattttcttctgttccggtttcgcaaaaaagtcggaatatcaagtgtatcttcactgtactgaacggcgcgttgcggttcagactggggttcttcacgctttgtttcgcgttttgcctgttggttcaaggccggccttgattgtccgagcgacgggcgctgcttgctctgggtctgcgcttcttcattaaagccggttgcaatgaccgtaaccacgatttcgtccttcaggctttcattgataacggacccgaaaatcatattgacttcctggtctgatgcggaggcgacaatatcggccgcttcctgcacttcatacaaacttaaatttgcgctgccggtaatgttcatcagcacgccttgtgcaccgtcaatagacgtttcaagcagcggcgacgaaatggctttttttgccgcctctgtcgcacgattttccccggaagcgatcccgattcccatcaatgctgaacctttattggtcataattgttttgacatccgcaaaatccaggttgatcaggcccggtaccgcgatcaggtcggaaatcccttgtacgccctggcgcagcacattatccgcttcccggaatgcttctagcatcggtgtgcttttatcgacaatttccagcaggcggtcattcgggatcacgatcagcgtatcgaccgcttctttcatggcactgatgccgccggccgcctggtttgcccgtttgcggccttcgaatgtgaacggccttgtaaccacaccgaccgtcagcgccccgagttcctttgcgatatgggcaatgaccggcgccgcccctgttccggtgccgccgcccatcccggctgtcacgaacaccatatccgcaccctttaacgcttcttcaatttgttctttgctttcttcggccgctttccgcccgacttccggatttgcgccggcaccgaggccacgcgttaattttgcgccaatttgcattttaatttcagctttggaaaggtttaatgcctgggcatccgtgtttacggcaataaattcaacgccctgcagatcatgttcaatcatacggttcacggcattgttgccgccgccgccaacgccgataacttttatcgttgccaaagcgtctacattggtatcgaactctaacattcactaatcctcctaattcgtattgcgtatcttatcccggtcctgctgccggacgggctccggttttttcgcacatgatgccggcaggctattcgaaaaacaaaccaaagaattttttcattttcgatgacattttttcttcctgaccggaagcttgttttggtttggactgcggctttttcgccggtttcggttccgcatactccattccggctgccaccaggcgggagctgacatttttcccttccagccgcgcatttttcgcagcgtactggatcaggccgaccgccgtcgtatattgcggctcacggacaccgatataatccggaatggcaactcttacgcggttttgaaagaccgtttctgcaagctccggtacaccgggcatatttgcagtgccccctgtcagcacaatcccgcccggcaaatcatggacgccgatcttcctcagttcctgctggataaacaaaaagatttcttctaatctagcttctataatatcagaaatttgtaattggttaaattgttctttttgttcactgccgatgatctgtacatcaaaaacatcgtcttcgagcgcatcctggctgaacgcgtgcccgtgcttcagtttgattttttccgcatcttccgttgaagcccttagacagatggacaaatcttttgtgatatggtccccgccgacgggcagcacgctcgttgtccggatatggccgttttcaaaaacagccagcgtcgtcgacccgccgccgatgtcaacgagtgccgtcccgagttccatttcatcttttgacagcgcaatggcaccggctgcaagcggcatgagaacaatttccgcgatggtcaggccggccttttcaacacagcgcaatgtattatgtaagatcgttttggaagtcgtgacaatgatgccttccatttccaatctgacaccgatcatcccgcgaggatcatgtatttcatccaaaccgtccacaatgaattgcttcggaatgacattcacaatctctctttcgggaggaatagaaagcacttgcgccgcatccatcactctttgtacatccccatccgtaatttcccggttctcgctctggaccgccaccaccccgtggcacggctgcagcatcacatgattgctggcaatgccgacgatcacgtggtcaattttcatgccgaccattctttccgcttgttcaattgcccgcctgatggacaggacggtttcatctatatctacaatcgatccttttttaatgccttcggacctgacattgccaaccccaataatatttaatgaatcattgcccatttcggcaatgatgactttcgtggcagatgtaccgatgtcaagactcacatatatttcactgctgttcatactgcggcacctccctttgcctttcgatcaaacgcaatccgcctatgttaaagcgccatttttcccaattcgtctcttctgaggcgggctctttttgccgttccgtccgtgagtccgccagaagcctccattcaaaaaggtgattataaacaaagtattctgcgtcataatcaaattccctttttttcaatcggacttttttcattttcttttggtgatcaaaatatttccagtctcaaaatatagcaattcctaaaatttggtttcatcataagtctacactaagatggacacggagaaaagcgaaattttttcatgtctacttcgaatcgtaagctttaaaatacgaaccgacttcgaggtcaatcacaccttttttcttcgggtcaagctgactgatgatcgaagggtaatgcgccatcttttctgcgaacgacggaatgcttgcgcgcacttcaaaaccgttattcatgtacagggtgacaaggtcacggtcaacgtttgaaggggtatagcggacttccgaaatggcatttgtgatcgaatccggcaatttttgcatctggcggatcatttcatgcaaatgcgtatcctgtttgaaaccggtaaatatcaggcttgcggccggaatttctttcaccgttcttttgacgaccgaaccgttatccaaaaccggcaaaaaaccgcctttctgctgtaaatacccgattttttgatgctctttcacttttatgtaaagcgtattcggcaaggaaatgcccactttcaccgaatcaacttcagggatggatgcgattcttttccggactgcgtctttacggatattccatatattctcacccgtggcaatgccgctttttttcaaaatgtacggcttgctgaccgcctcatttccctctatctgaatgcggtggacgcggctcagcggggactcgaggtagatgatcagcatcaccagcataaaaaaaaccgtcagcagcatgatgagccgccggttcgtttttcggcggcgctgctgctttaatttcgggatccggtcttccagcgaaacgatgtttttgtcagaccgcgccattttgttcctcccttttttatttgccgcatcacgatttggcttttgcggccagattttccatcacttcataaagccgccatgaagcgtcacgaataccgagcttgcgggcggccgcctgcattttctccatctgttcccgatccagcaaaattttatcaatcaaggatacgagctttgcggaagataaatctttttcaagcagcataaaagctgcgccgttttccacgagtgttttcgcgtttttttcctggtgattgtttgtcacataagggctcgggattaagatacttggcaaaccgagcgccgtcagttcggccaatgtggttgcccctgcccttgagacgacaagatccaccgctcgcaacacttccggcatattgtggataaacggtaccaccttgatatttcctttttcgccgatcaatgcaatttcttttttgacggcctcataatgcacatcccctgtcgcataaatgacctggtaatttttttgtgcaaaattggaaaaagatttcacaaccgcttcattaatcgggcgtgccccgcggctcccgccgaaaatgagaacggttggaagcgttgttttcaggttgaaaccggaaaggacgccgcgccttttgtccccgatcacttccgatgcgcgcggattgccggtcagcaccacttttttctcatcaaaaaaagattttgcagattcaaagcaaatggccactttgtcaacgtaccggcttaaaaatttattcgtcagccccggcacgctgttttgttcgtgaatgatggtcgggatgtgcagtttggcggcagcgtagacaaccggaccgcatacatacccgcctgttccgatgaccacatccggcttgaattcgcggatgatttttttgcaccggcttaccccttttagaaagcggacaaccgttttgacattttcaaacgaaagggagcgtttaaaccccgtaatatgaatcgatttgaacggaatgttttcccgcggcacaagccgggattcgagccctttttccgtgccaatatacaaacattccgtgtcaggatgtttctgtttgatcgttctgatcaatgccagggccggataaatatgcccgcctgttccgcccccgctgacaatgattttcatgtttttccacctcaggacgccgtgctgggttgcacgggtatcaatatatgatgtttgaaacattcatttttctatattactatattttaaacgacaatgggtgcacagtaaaacgattattaccaaaatgttaacttgttgtcaaacgaaaaaagaacccctttatgaggttctccttccgttacagccgggaatggcggctgatgtttaagagcacgccgactgcgacaagcatcaacgtcaaagaagagccgccgtaactgatgaacggaagcgtaatgcctgtaaccgggatcaggccgatgacaacgctgatattgatcatcacctggatcgcgatcatggaaataatgccgactgcgagcaggcttccgtacagatcgggtgcgccaagtgcgatccggatgccgcgccagagcaatagcgcaaacaaaatcaggacaaaagtcccgccgataaaaccgagctcctcggaaagaatggcaaagataaaatcattttgcggttccggcagatagtggaatttttgtttgctctccccaagccccatgccgaacaggccgcctggaccgatcgcaaggagcgactggataatttgaaatcctttcccctgcggatcggaccatggatcaaggaaagaggtgatccgtgcgatccggtatggagccgataaaacaagagcgacaaaaccgcccacaccaaggagcccgagcatgacaaaatgggcaatgcgggcgccggaaacaaaaatcatgatgatgcatgtcccaagcatcaccgttcccgttccaaggtccggctgcagcataatcatcccgaaagcaacaaaaacgagcgccagcgccgggagcatgccttttttaaaagtcgtaatgtatttctggttctccgataaaaattttgccaaatacgcgatcagcgccattttaatgaattcggaaggctggatggaaaatgcgccgaccccgatccagctccgcgacccgttccgttcaagcccgatgccgggaatcaaaacaagaacgagcagcacaaaacagatgatcaggatggttttcgcccatgcccgccacgtccagtaatcaatgcgcatcacgaaaaacatcgctgccacgccgagcccggcaaaaagcagctgccgcttcaaaaaataaaatgcatcgttaaatttgtattccgccacgatctcgctcgcgctgaacaccatcagaagcccggttgcaagcagcgccagggtcacaatgattaataaaaagtcgggattcgtttttttcgacggcatccgcgcccaccccagaaaagatttagagcttcccgcaaaaaccggcaacccgcgccggccaaaaacggtccaagcccttatcttaacttatgcacggcgtcgatgaaaatatcaccacgaatttcaaaagatttgtactggtcccagctggcgcatgccggcgacagcaaaatgcaatcgcccggttcggataatgcccatgcggccgggactgcttcttccacgttttccaccgtgcggatgaccggaatgcctgcttttttcgcggtgctttccagtttcggcgctgtttccccgaaagtaatcaatgctttgacatatttcaaagccgggatcagttcatcaaagccgttgccacggtcaagcccgccggcaagcagaatgaccggctgatggaaagcggcgagtgcggctttgcaggccaggatattggtcgcttttgaatcgttgtaaaatttccgtcctttgatttcgccgatatattgcgtccggtgcttaacgcctttaaacgttccgagcaccccgcggatggcatcattacttgctcccatcagcttggcagcggcgacagcggctaaaatattttccaggttatggtctcccggcagcacaatttcagcgcggtccatgattttttcgcctttccacatgatgctgccgtcttttaccgatgcgccgtcttcaacatattccttcgttgaaaaaggaataatttttgctttcgtgaaggagaccagatcccacagttccggctgggcatggttcagaatcaggaaatcatcctctgtctggtttcgggtaatatttgattttgcttttgcataagcttcttttgtcccgtgataatcgagatgggcttcataaatattcgtgatgatggcaatatgcggcctgaatgtttgcacgcccatcagctggaaagaagacaactccaccaccatctgctggtccgcgcgtgctctttgcgccaccgtggaggccactttgccaatatttccggcaattaacggatcaagatgcggatccgcctggaaaatttcataaatcaacgtggtagtcgtcgttttcccgttcgttcccgtaatgccgaccatcgggcattctgcaattttataagccagctcgatttcggtaatgaccgggatccctttttcaatcgcccccgcaacaagcgggttcgaataagggatgcccggatttttcacaatcagttcaaagccttcatccaatagttcaattggatggctgccacaaatgactttgatcccctgttccaaaagcccctgcgcctccgggttctcttcaagcggtttataatcattcaccgtcacaaacgccccgagccggtgcaacagggaggccgcgctcaccccgcttttcgccagcccgagtaccaatacttttttatgttcatattccgtgatatttttcatgttacatccacacctcgatataaattcctaaaatcgcacacaaaaggcctaccgcccagaacgtcacgacaacacgccattccgaccagcccgaaagctcataatggtggtgcagcgggctcatcctgaaaattctttttcctgttgtcttaaatgatatcacttggagaatgacagacaaagtctcaataacaaaaacgccgccaatcacaattaaaagaatctcaagattggtcagaatcgaaatggcggcaatcgctccgcccaatgcaagtgagccggtgtcccccatgaaaacttttgccggatgggcattaaagacgagaaaaccgagcacggccccgacaacggcaaccgaaaacagggcgacatccgcctgtgactggttccatgccaaaacggcgaatgccccgaaagcaatcgctgccgtcccggatacaaggccgtcaagcccatccgtcagattgaccgcattggaaaacccgacaagccagagaagaatgataacaaagtaaaaccagccgaaatcgaccgatttgtccgtaaacggaatcgagacttccgaagataaatggaagtggcggaaaacgacataaaaaatgatggcaacgagaatctggccgagcagtttctgctttgatgtaaggccaagattccgcttcatcaccactttaataaagtcgtccaaaaatccgagcagcccgaatccgatcgtcacaagcagcaaaaggtaaattcttacagtcggttctgcgaatttaccggccatgatcagtgtggatgcaatgatcgataccaaaataatcaagccgcccattgtcggcgtcccggattttttctggtgcgatttcgggccttcttcccggatgctctggccgaatttcaatctccttaaaaaagggataaaaacgggcgaaagcagcacggaaatcaaaaaagccatcagcgttgtaaaaaaaatcacttgctcgatcatgctttttccctcccgtggcgcctgcatgcacaaagcagccgcttcctgttttccgcatccgccaaatcatatgtatgagggtttttttcccgcaattccggtccgtaaaaaataaaagttgtcttcatatccaaatccttgctttccattttttttagataaaactgtaccagttgtgtaaaagcaacagaaacatcctctgccataaacagtggaaaatcattcggtatatagcggggcacgggtgcatcgtttttccaaagcgccgcgattgccccgtgtgcaattgcccggttaatgtccggttcagaaaaagggacgtataatccctttggctggtttacatccgcaaacacgctgactgtggcaaattcgagcgccatctccatgccgcggcccaaactgaaaaggcgggctgtatccccgaatgataacatatgcttcaccgctcctttatcatttccagtgcaacttccctgtcatcaaaatgatgcacttcatttccaatgatttgatacgtttcatggccttttccggcaatcaggacaacatcccccgcctctgcacggaaaatggctgttttgattgcttccctccggtcggggatgcattcatattgctcaccttctacccctttttccatctcgcgcaaaatggcaagcggatcttcactgcgcggattatccgatgtaaaaatcggataatgcgcatatttgcaagcaatttgcgccatcaccggccgctttgttttatcgcggtcgccgccgcagccgacaacgacaaagatttttttgcgggcaaactgccggatcgttttcaggacattttccagactgtcgggcgtgtgcgcgtaatcgacaatcacggaaaaatcctggccgccgtttacgagttcaaaccggccgcgtacgccttccatcgcttccgccgttttaatgaccgaatcaagcggcaccccggaaacaactccggctgcgatcgctgcaagcatattatagacgctgaacttcccggcgagcttgagccgaacttcccgtttctcaaaaggcgtcacaagcgtgaatgttgtcccgcgggcgtgcatgtcaatgttttcggccataaaatccgcatcatggtcgatcccgtacgtaatgacaggcaccgcggttacttgttcaaattcctttgatgcggcgtcatctgcatttaagatggcatatttcggcttatcttgcgggcaggagttcccgagctgcgaaaacaataaacttttggcgcgccggtattccgccatcgttttatgataatcgagatgatcctgcgtgagatttgtgaaaacggcaatatcatagtcgcagccgtgcacccggccttcaacaagcgaatgcgaagaaacttccatcacacaatcggtgacaccgcgcgcgttcatttcatggaatgttttttgcaatgtcagactgtccggcgttgtgtttttcgtttccagtgtttcatcgccgattttcatatacatcgtgccaatcaggccggtcgttctgcctgcatcccggtatattttttcgataatatggctcgtagttgtttttccgtttgtgccggtaattccgacaaggcgaaacttgcgggacggctgcccgtaaaaccggtctgcaaggagcgccattgcccgttttgtattgcggacgataataactggtatatccacatcgaccggcttttcggctaaaatggctgctgcaccccgtttggccgcatcaacggcaaacttatgcccgtcaaccgtatagcccttgatacaaataaacagactgtttttcgtgacaagccggttatcctggacaagttccgtaatttccggattcactgcaggcattttcacaaatggtaatgcctctaacaatgtatgtaacttcattttgcttccaacccttcctgttccaaacccttgttgctgcatcttctttgtgtatacatgtaaatacagtccttttctattgtacaaaaaaaacggccattaagctatgaagtcctgttgatttttaaaatgtacgccgaaagagcttgtttatgcctcttgaaacaaaaacacgggcggccggacatacggcgccgccctgtttttctgcatgcaaatccggattgttgagcctagcggggcccattccggaattggtgaatctattttactgcatgtaaacccggatcgttgagccctcttccactttcacgcctgcttcaggggactgccggatcaccttgtttccggatccgctgacatcaagtttgagattatattgatcgttcatcatctcttttttcgtctctccgattaaattcggcacttttaccgttggcgtttcaaaataacttttttctttttccgcctggtttttcaccggcttgacgcccatggcacgcaggctgtcgccgatgatcgtgcccgcgatcggggctgccacctggccgccgaattggatcgtatttttcggattatcgaccgccaagtagacgacgattttcggatcattggccggggcgaaaccgataaaggataaaacataattgttttcgagatagcggccgtttttggctttttgcgccgtcccggttttcccgccgaccggataaccgtccacataagcattttttccgctcccttgtgtgacaactgtttcaagcgcatggcggatttgtttcgatgtgttttccgagatcacccttcttttggcaaccgggtttttccgcatgaccgtttcccctgttttagggtcaacgagttcctttgcaatatacggtttgtaaagaatcccgccgtttacggcagccgagaccgctgccacctgctggatcggcgtaacagaaaccccctgcccgaaagccgttgtcgccagttcaaccggcccgacgcggtcaaggttgaacaaaatgccggaagcttcgccggatagatccacacccgtttttgtgccaaacccgaaattgcggatgtatttgaataatgtattttttccgagcctttcgccaagttcgacaaagcccgggttgcatgaattttggacgacttcaaggaacgtttcgctgccgtgcccgccccttttccagcagtgcagcgtcgagcctccgacttcaaccgcgccggaatcgtaaaatttgtcttttgtcaaattcactttcttttcttcaagggcggcggcaagtgtgataattttaaatgtcgagcccggttcgtatgtgctccagatcggcaggttccggttatacacttcctgtggcacatttttataattgtcaggcgtatagctcggcctgctggacatcccgagaatttccccggtgcccgggtccatggcaatcgcaatcagcccgtccggatgatattttttttcagcattatcgagttcacgttcaataatcgtctggacttttgtatcaaccgttagtttcaggtcaagcccgttttttggcggttcatattcatctgccatatccttcatctttttcttcccttttgcgtccgtataaaactcgactgcccctttttttccgctcagcgcatcatcataatacagttcgagcccggtcagcccctgattgtcggcaccagtgaatccgagtacatgcgaaaggtaacggccgaacggataataccgcttggaatcttccgcgatatagacccctgaaagcccaaggcggcgtacggcatttgccttttcattgctgattttccgcccttcttttattctgacaatcgatctgacctgtgtaatttctttataaagcttttctttgtctgcatcaagggcgtcccccagtttttcagccgtttttgccggatccttgacctgcctcggaatgataaaaatcgtcggggcactttggttggaggcgatcggcacaccgtttctgtcttcgatttttccccgctccccttcaaaagggatgcttctgctccatagcgcttttgccctgttcgtcagcatatccccgagcccgaactggacatagccgagccgcacatctataatgctgaaaatgacaatcccgcaaagcaatataaaaacaagccgctttctcaccgtaacattggatacacgtttcacgagcgcgcctccttcatttaaatctcaaagcagcagattcctgggtaggaaagatgaaagatttcagccttctcttggtttcctttaaccctgaaaaatccgctccgggcgcataaaatgccctttgttgcctttatacccatttatatgcttgtacgcatccggctagtaccttttcacacgcatgaaaaaaagcaagccttgtgcttgctttttttcggtattccttctaccggccgcctaagggtttttaaattttacagtaagggcctgtccggatttcacttttgattttgccggaatgctttgggatacggcataaccttccccgcttatggtcaggcggaggccgagcagtttggcagcgcccgccacgtcgcgtttcgaaaagccgcgtatatccggcattactttattgccatttgttttcaaaaatacttttgcgcccggcagcagttgtccctgtgccctgggttcctgggccgttacggcatcgccatcgccgagcacaacaggggtaaggcccaatgcttttacggcagatgacgcttctgaccggctgtcacccgtaaaatcaggaagcttggcaaggcgtacggtctttccttttgccggtttaatgtttaaatattgcaggctgttcttcataatcgggttaaacagcgctttaaccggttcgccgccaagctcgccggcttttaaatgcggctgctggacaacggcgtaaacgattaatttcggattgtctttcggcgccataccgagaaaagaaaagatataattatcggtaccggttaaatatccgccgccgttcggattcgggatctgggcggtaccggttttgccggtcacctcgtagcccggaatgttataggccgtgccggttccggtttttttattcgtcacaaccgtccgcaaataatcccggacttttttcgcggtatccgcgctgatcgggttgccggcaacggttggttttgttttttccgtttttccggttgcgggattgaccactttctcgactacatacggtttcatcattttcccgtcattggcaatagctgttgccgcctgaatcatctgcatcgcggtaacggttgtaccctgcccgaatgtcgacgtataccgttcaatcggataatcgtataaaattttgccggaagcttcattcggcaagccgactttcgtctgtttcccgaacccgaacgcttccaaatactgcttaaatttatcctgcttaatataatccagcaatgtggcaaatgcaacattagaagaacgctgcagcccttctaaaaaggtgatcctgccccagccgaccccgccattatggtctttaatcgggtttggcacatttttcacccggaattctcctgacttataggtcgcattcgggtgaaaaacgccttcctggacggccgccgccaaggtaaaaattttcatcgttgagcccggttcataagcggtttcgactggatcgtcctgccaagcatcgctcaaacctttccgcgtttccggatcaaatgtcggccgctgccccattgccagtatcttacccgttttcggatcggccacgacaacaaacgcttttttcggattgtattgtttctggactttgccaagcgcatcttcaacgaaagactggattttcttgtcaatcgttaaatagacattttccccgtttttcggtttggtgacttttttatgcgcgtttggcaaaatatatccccaaaagtcgccttcataactgatttttccgtctttgccttccaaagcggcattcatgcttttttcgattcccattacacctgccatttggccgcctgtctcatttttctgcgcatagccgaccagatgggaggcaaacgaaccgttcggatacgtgcgtttcggcacggcttcgaactggatgcccggcaagttctgtttttgaatttcattttttacgttatacggaatatcctgccccgccttcccgaactccacttgaaaccgccctttttgtgtcaggagcgaataaatttttgattcgggcatgtcaatatatttcgcaagggcctgggcggtttttcgagggttgacaacatgtttcggatgttccggatcaatcgtgactttcgggtccaaaacggcgaccagattgtacgaaacaacattttcggcgatcacttccccgcttgcatcgtaaatattgccgcgggaagcgggaatggcgcttgtccgcaaatattttttcgccgcttttgccgcgagcactttcccgtctgcctgccctgtgatttcaatcgtcaaaaaccttacggcgataataaaaaaggacagaccgaatatgataaataatatcgctgcccccctgtttgtattcagttttctggacttcatttattttcaacaaccttgacattattctcgtccaatttcaagccgagtttttttgccttttcgtaaatacggtcgtagcggctcaattcgcttacttgcattttcaaatcatcggtcaccttgtttttgttctggatcgtggtttttgtatcttcaatcgaccggttgacattataaattgcagcttccgtcgatacgatcttcacggccataatcaacacgaacaaagcaaaaaggcttgcgatgattttttcccctaaagtgatctgcgcgcgtcttgtggccggtgctactcttttttcaatctgttgttgctgttccagcgcacgtttcggctgccttgctaaattactcaaaaaactccctcctctattttcttagcgtttttccgcaatgcgcagtttagccgaccttgaccggttgttctcgcccacttcctcatcattcgggacaatgggtttcctcgtaatgagttttaatacgggctcgtattcttttgggatgacaggcagcccatgcggcaaatctcctgcactgctgtattctttcaatatatttttacaaatgcggtcttccagggaatgaaatgtaatgacagagacccgcccgcctggttttaaaagcgaaatggcatccgttaaagacgtttcaaaagcagataattcatcgttcacggcaatccggatcgcctgaaagaccctttttgccggatgcccgccttttcttcgtgcgggtgcaggaatcgcttctttaattaaatcggccagttcaccggttgtttcgatcggttttttggcacgggacgcctcgattttgcgggcaatttgttttgaaaatttttcttccccgtaccggaaaaagatccggaccagtttttcatacggccattcattgacgacttcataagcggtaagcggcgcatcgaggtccatccgcatatcgagcggtgcatcatgctgatagctgaatccccgttccggtgtatcaagctggggagaggaaacgcccaaatcatacaagatgccgtcgacagcctgcacaccgcgcgcgttcaattctgattttaaataccggaaattgcttttaataaaagtgatcctgttttggtcatgggcaaacttttctttggcatgctgaatcgccgtttcatcctggtcaaaagcgtataaatgcccgccggtaagctgctgaagcaaataggcgctgtggcccccgccaccgagcgtgcagtcaacataaatcccgtccggtttaatatgtagcccgtcaacggtttctttcagcaaaacggtcttgtgttgaaacatactgaatctcctatccaatcgaacatgttaaaggtcaaaatcgatgaggttttccgcaatatcagcaaaagaagcctccgattcctgaaaatattcttcccataaatctttgctccaaatctcaattcgattggaaacgccgagcaccacgcattctttttcgagtttcgcataggaaaggagcggtgcgggaataagaatgcgcccttgcttgtcccactcgcattcggtcgcccccgaaaagaaaaatcgtgtgaatgcgcgggcatcttttttcgttaacggaagggacttcagtttttcttccacctgtttccattcatccgcagggtaaccgaaaatgcaacggtcaagcccgcgggtaatgacaaacgtatcgccaagctgttcacggaatttggccggtacaatcaaacggccttttacatcgatattgtgccggtattctcccatgaacattggcgcgtgccccccgcttcccacttcatattaataatttaccacaatcccccacctttcaccactttaatttttatattctcctcgcagctccgttttcctgctttttgcaagaaaaaatcaatttaaaacttgcctgccgtaaagccttgttccaacatggtgagtcccggcaacccgctttttcgctttgcaattattttttcaaaaaagcatcatgaaccaaaaccacgtcggtatcgtgcgggaagcgtctttacaattcatttttccaacaaagcatcgtgaaccaaaaccccctgtttttttgcataaaaaaagccggccgctgtcagccggttaaattttaacgagtttatgtgtgccgtcaaatgtgaacggcagggcggcaagggtgtggataaagtccgccccatatttgttaaggaaataaaaaaggttccagaccctttcctggggattgccgtccgggcgcaaggcacgttcgacccgcgcgtatttttcaaggatgttttcatgttttcccgcaatctcttcatccactttccgctgcaaaaacgcaagctgccccaggtgaaaatcgagatttttgcgggcaagcggttccaacccctttccaattgcggcaaaaattttatcgtattgcattttcagcatgttttccgtttctgcaatgagcgcgtccatattctcatcttttgcgtcattccaatatttttcccgctctttccgggtcccgtattttaatacatgcccgatatcgagttccagttcctcgatatccctttggaccgctctctcaagcaacgtgatattgagtcgcggcacaagaggcggcatcagaatccccatttcttcaaacacccgcttcagctcggcccagtacgcaatttcgcccggcccgccgataaacgcaagggttgggaagagccattcctgcataagcggccttgtgacaacattattgctcagccgttcagggcttttcgcacaaagcgcgcacaacgcttcctctgtaaaaaaggggctgccgccttttccggtaaatccgccttgctccggactgtactccagcaaaatccgttccttgccgtcataataaaaaagattcagcgcccgcctggaaatatcaatcgcttttggaaactcaaactgcgcgatttcctgctgctgccagaggaccgcttccgtaatcttgtcataatcctggatcatccgttcaaaaaacggcgcctcgatcttccgcaagtgtgcatcagccgaatcgatgagcagcaccccgtatgccttgaaaagatcgtgaatcatgcaggcaaacaggtcagaaaggctttgtgccctgtctgcaaacgcctccagcttggaaagaagggcattggtatgttcggtttcgccaaatgcttcaaaaactttatgtatccatttttttaaatgggcaggatccggtgtggtatcagagatcatttttttctcaagcggcccttcagcataactaaatttttttaaacgcctttcctgttcggcataaatatggttcacttccaaatagtcatggtcctcgcccgcgatccagaaaacaggtacaaccggaatttgcagggcttcttcctgctcactggcaagccggataatcgaaatcagtttatggatcgtataaagcggccctgttaatagccctgcctgctggccaccgatcacaacagcagcgttcggctgccttaatttttccaaggaatgggccgtctccggggagattccaaatttttccatatagtgcccgatacaatctgccagcccttcccggttaaaagcccgtttttttaaatcttccactcttttatggaaaacagaagcatccgttatatcataatgaaaaaaatcctttacaggagatttttgcgcaagatagagggaagcgaaccgattcgttgctggaattgaaaagttttccagttccatcaaatgattcttcctttctcgttttcattgattttctcattgagtatagcatttttgtgaaaaaaagaaaaaaagcctgcctgctcgttgcaacaactgaaaccttgtttccggccgctgcgggcacggcggcaacacacggaacgtgcctcaccccttatcctccatccctttcaccatttcataaagggcggacgcaagcggaacctggctgttttgacgggcagccgtttccagcatgtaaccgagaatcgcgtcaatctcggtccgtgctccttttttcacatctttcagcatggacgattcattttcgcacgtatttttgcaaatgccggtgacttcctcccacatcttttcccgcgaaagtttcgggaaaagcgccgccagttcttcaaatacggcgcggaacacacgggcataatgcgggtttttgaccagttccccgttctttgcctttaaaacggctgtgagcggattgatgacggcattggcaaaacatttgcgcaaaagcatcagctcataatccggctgcaccgtgaacgggaaagcatccgtatgcaaatgcacgctttcatcccatttcccgcggtagacggcgatattcgttttgccgtgcccattatgcttcaccgttgtgccgtcaagccgggatgcgccgtgctctaccgtaccgacaaggatcgttttttgcggcaattcttcaagaagaacaagatggcccatgccgttttgcaaaaacaagaccggcaccccgccatcttcgttttttaaaacggttgtcacagcaggaaggtcatattgcttgacggcaacaatgactagatcctgggaggaaagcgaagagaacgtgtcatccgctttgacgaaagttctgaacgaagatgcgccgtcttttacggtaatccctttttcattcagctctacggcctgcgccttcgtatttggaaacaaggtcacttcatgcaactttccaagccaacccccgtataataaaccgatcgcaccagcgccaatcaccccaattttcattttgcccgcccctttccattttctttgctccattttaacaggcaataagggaatggaaaagaaaattccagacaaatggtgtgcgaccgtttacacgtatttctttcattcttccaattgtttgttatataatgataatatcaaccggttttatgtaagaatcgccgccatgctgctgcgacacagcatataaagagggatgggggaattgatatggcttatcaagtggaaaggctgaaagtgaactacaaaacgctcgaagaattcaagcagtttaaagagtacgggcagcaggaactgtccatgcttgaagatttgcaggacaatattattgaagacaacgccgactcgccattttacggcatttattttgccgataaactcgttgcgcgcatgagcctttacgaacgggatgcaaaatacgatctctattttgaccccccgcaaacatttttggaactttggaagctggaagtgctcccgaactatcaatataagaattacggccgggcgcttgttgattttgccaaaagcttcgggctgccgattaaaacaaacgcccgcctgaagtcgcgaggattttgggaaaaaatggggttcaaacctgttccttataatgtcgaacgcgatttgagtgaaaacccgtttgtctggttgccgcacggcgtgaagctgaaagacgcaaaacaggataaaaaaacgacctcttcttaaagaaccggattccggttctttttttgccttttacgaacaaaaaatgtcccctgccttttaaggtccaggggatgtgccgccgttttaatcttgctcagacaactgccgtgctttttccataatggaaaggagcgcactgtattctttttgcagctgctcatgcttttccttttcttcaagatacttttgaagcagcgcctcatatttgcttttccattcctctgtaccgcgccgggatgcggacaactgcccactctcgtgcctgcttttttccgcaagctgctgaaggatacggatggcatcaaacagcgttgcttctgtctgctgcccttcttcagccggtgctctcccggaatctcggacgagctgctttctttcctttctttctttttttgcggcttcaatttctgaggcgtactgctttctcacataagaattccacctgaacccgcatgccgctgcggtccggttcatccgcttccctgcctcttcaaacgcccggagctgcgtgctgccttcgcgaatatggcgcaacacaatgtccgatagcagcaaatcttcttcctgtgtccaggcatcctgtctgactgccggcatatctttccccccatcctttttaatactattcatatgccgttgatagaaaagatagacgaaatttcgagaaaaaaaggaggaacggggagaagcttttggcggaaagggatggcgttttgaaggcaaataaaaaagcacgggtttgcgccgtgctcttttattatttatttaccacaactttgtttttgtaataaccgcaagatgggcatacgcggtgtgccattttcatttcaccgcatcgcgggcattcaatcatgccgggaacttgcaatttaaaatgtgtgcggcgttttctttttgccgttttagaagttcttctaaaaggtacagccattcttcccacctccttataagagatcagcatatcatttagccgaagatggcggttattcagaatcctggtcaaaaaatttcgcaaggtcggccatacgcgggtctaccgctttttccgccttctgctccatttccaaatactcgtcctccgtcagcacctgccagttgtccgtatgcggcagttcgccttttttggcttcctcactgaaaacctgcatgggaatgtcgagcaaaatcaattctttcataaccgggatcaaatcaatgacctcattttcggcaacatgcacttcttcatcttcagcaccttcataatcggaaggctcaagaagaaacgtttctgtcgatttcaagtctaccgggtaatgtacatcaacaagcgtccgggcacaaggcagcacaagcgttccttcaatgtgaagatcaaacgtcaccctgccctgctgagcactccccgttcccgttacgtggaaaggcgaagccccgcggatctcggaatcagtttccattaaatcttttgtaatatcaaccgattcatctatctcaaagcgcttgtcccgaaatttttgcaattgaatggcagaccatttcactttcatcaccccaagacaacaaaggtaattatagcttccctcataccttttgtcaatattttttgctttacaaccatgatgtccaaaacgaaaatttttcttcaaaccagaaaccggcccgggcttgtttaagacgcgtcctttttacgctttcatcttcaagactccccgttttttcaaaaaaattttgcagcaggcaggattgctttttttgccggttatgttaaaaataacttatcccaaacgggtgcttttaaacatccaaatcttccggaaaggggaatcacaattgaaaagtaccggcatcattgtggagtacaatccttttcataatggccatttgcaccatcttcgcgagacgcggcggatgacaggcgcagagtgtatcattgccgtaatgagcggctattttatgcagcggggcgagccggcgcttgtttcaaaatggacgcgggcggagatggccgtattatcgggcgcggatctcgttgtcgaactgccgtatgcatttgccgtccagcccgccgaaaaatttgcggcaggcgggattgccattttggacgctttgcagtgcaaaagcttctgcttcggcagcgaatccggcgacatcgaagcattccgccaggcggctgccgtcctgcttgaaaacgaagcggcatttaacgcatccgtcaagcgcgaggtcaaaaaagggatcagctatccggcagcgctatcaaacagctttcagaagctcgcaccaggcgacagtacgctcgatttaagctcacccaataatattctcggcttccattatatgctcgcggcagcaaggcaaaacccggcgatggaggcttttaccgtccaaagaaaagcggctgggcaccatgacgtcgcgataaccggtgaaattgcaagtgcaagcgccatcagaaaaaccatcttgcaaaccgaagatctgcacgctgcccgcccggtgctgccggaaccagcatttcatgtactgagccggcaccgcaacaacaacgggcacttcctgcattgggcgctttactggccttttttgcactaccggctgctttcctcatctgaagaagaattacgcgccatttatgaagtggaagaaggcattgaataccgtttaaaaaaagccgcggcatctgccaacagttttcccgacttcatggaaaaagtgaaaacaaaacgatacacatggacaagactgcagcgaatttgcacccatttgttaaccaatgccaaaaaagcagaaatcaaaaagcatgcggcaaagccggcgtatatccggctgctcgccatgaacgaaacgggaaggcgctatttgaacagcgtgaaaaaaacggtaccggttcctattatttcaaaattttcgctgcaaactgccccgtcgcttgcaccggacataagagccgcgcggatatatgccctcccgcttccggcaaacgaacgggaacacttaatgatccgggaattcagcaagccacctttttttgcagacgaaaaaacggatggcgcgtgaatccgtaggctgtctttttacaggcggaaaagcttcgggcatgcggctgggaagaaccggatgaaacgcatgattttatgagaacggctttttgcagacgagaaagccgcatacttaggctgttctcctttttgcaagcgaaaaaactgcaggcatgcaggctaacacctttttgcaagcgaaaaaccgatgaaacgcatgattttcagctttttacaggcggaaaaccggaacccacattacatttcagacttgcaggcaaaagcccgggatgcgtgacagccttcccccttctttacagggaaaagccgctaaaacaagcggctttccggttatttttgtttcaggccgtttaaataggcgagtgcatcatccagtgttttgaccggtacaattttcatgttcgtcccgatttctttcgccgccgcttttgcctcttcgtaattcggcttgatgccaggctcggcttttttcatttcaggtgtaatcgtatcatctggagcaaagaaaatgtccgcccctgctttgtccgctgcaatcacttttttatcaatcccgccgatgcggccgacctccccgtttggcgaaatggttccggttccggcaattttatagccttttgtgatgtcctgtttggtcagctggttgtagatttccaatgtgaacatcagcccggcggaagggccaccgattttttcggtatccattttcacagccgggtcggatttgacggtccggtcatcgacaaggctgatcccgattcccgttttatgatggttttccttgaattttgcaagtgcaacggttgccatcttcgcctttttatgacgcatatagtccaatttcactttgtccccggcttttttctttgcgacatagttcataaactgtttggaagacttgaatgcatggccgtccacttttgtaattctgtccccggctttgagcacttttgcggccggcatcccgtcatatacattcaggacataaatcccttcgtaatgggagctgaacggcctttttgccttcttaaaagcagcctggatggcattatgttttgctgattccattaaataaagctgatagacattgtattcctcgtccgtcatatttttatccataatttcacgaaccggtacgacatcctcgtgttttctcatttttgcccaaagatacgtatacggattcgcgcggcccatacggacagtcgtcagcatcaattggcctttttcaggatagccgccctttactttgatcagcggggcaagctgcatggcactccccggcatttcaatataataaggcagcggcacaaaggacaggagggcaagaatcagcactgccacaatcaatatgcgccgccggatgtttcggtgtttcatttgtcgggctccttccatttttccagcaattgctgtatttcagttacggattgttttgctgcttcttcccctatcttaatgatttgtccggcatttgtaaaagccattgaactgtacattgagacatcggggcggatcaaaacatgggcttccgttttccggctttcggccagttccatctgcatgatatcgatgctttgcataatcacatcataaatatggcggatttccgcttcttttttcatgacggaaacatccaccccgatcaaaagctccgcccccatttcctttacaacggacaccgggacgcggtccaccacaccgccgtccacaaaaagatggccgccaatttttttcgggacaaaaatgccagggatggaaatgctggcgcgcaccgcttcttgaaccggcccttttttgaacaccgttttttcgccgtttgaaagatttgcggcgacaacggcaacaggtgggttcaattcttcaagttttttcccatgaacgagcaaacggatcagatcttcaattcttttccccgaaatcaggcccatcttgccaattttaaagtccaaataatatttgcgtttaaatgcaccggaaagcagctccatctcgcggacagtccgccccgccccgtacagcgccgcaaccagcgccccaatgctgctgccggaaatcatatccaccggaatgccttcctcttcaaaaactttcaatacgccgatatgcgcaaagcctctggcgcctcccgatccgagcgccaatccgatttttgggcgacccgccattgtccccctcctcgtgtccttctttcgtacagtttatggtctaatttacagacctatgagtatatttgatttatagggacaagcgagcaagtgctgcggattgaaagacaggggaggaacacagattgtaccagtctaaactcaaaagcgccattttggccttcagcgtttcgataatggcgatttccatgattgtattgccggatgaatcttttaaagcctccattcaaggtttaaatatgtggtgggaagtcgttttcccctcactttttcctttttttgtcatttctgaactgctgatcggcttcggagtggtccgcttcgtcggtgttctcttggagccgttgatgcggccattattccgtgttcccggtgttggcgggtttacttgggccatggggcttgcttccggcaatccttcaggggcgaagttgaccgcccgtctccgtcaggaaaaacagattgaccgggttgaagcagaacggcttgtagcgttcaccagttcttccagccccctttttattttcggggcggtcgctgtcggctttttccataatccttctctcggccttctgtttgccgcggcgcattatgcgggcaatattattgtcggcctggtgatgcgtttttacggaaccggcgaggatacaagagggccgaaaaagaaacatacttttcttttaaaagaagcgcttctcgttttgcatgcgacaagaattaaaaacagcaagccgatcgggaagctgctcggggacgctgtcatgtccgccatccagacgcttctgatgatcggcggatttatcatcctgttttcagtctttaataaattgcttctgtatatgcatgtcacgtccgtattcggcatgtttgtctcccagctgcttcaccttgcgcatttttcggaaaagctgagcatcccgctcatttccggccttttcgaagtaacgctcggaatccaaatgatcagtgaagtgcaggaatcctcgctgcttcagcaggccatcgccgcgagcttcatcctcgggtttggcggattcagcatccaggcacaggtggccagtattcttgcccagacggatatccgtttccggccgttttttcttgcccgcctgctgcacggttttctgtcggctgtgatcatccggctcgtttggaatccggtctacttacgcttttttgctgaaaaaagcgcgtggcaggaagcttttggtatgccaggtggaggccgcagcttgtacgcgcgtgtgacagattggcttgaaatctacgggccgttgtttaccctgtcctgtcttgtactgtacatttttctttattatcgtgcctgccgggcggaccaggcctgaaaaaagcgcaaaaaagcggggagcattcccgctttttctgatgccttcgcaaatttttcaataaataaaccgggcctgtttttaaagtttttagtgcggtgtataaacggcatgtccggttttggggagccggtttaaaatgtacatccggcccagcccgggattttccggcactttatgtacggccggtatgtccggttcccattgctttttctattgtatcaacacttctgtgttcgtccagctcttccggaatgtccggttccgcccgcttttctattgcccctgaaatttctttttcaatgcttcatgcacaactggtggtaccagttccgcaatattgccgtggtatttggcgatttctttcacaatgcttgagctgagaaaagaatactggttgtttgtcatgataaaaaaggtttcaattctgtcattcagcacacggttcatggacgtcagctgcaattcatattcaaaatccgaaacagcccgtaagccccggataatcacatccgctttttttgattctgcatattccattaaaagcccctggaaggaatcgacttccacattcgggatctcttttgtcacttcccggatcagcgcttttctttcttcaatatcgaaaagcggctgttttgaaatattgttcagcactgccacatagactttgtcgaatacttttgcccctcttttaataatatccaaatgcccgtttgtaatcggatcaaagctgcccgggcagatcgcggtcttccccacgggtttcatccccctttttcgtgtaaatcgtgatgccggtgatgccgtactgtgctgttttatatgtaaaaagattgcccgctttttccggtaaggtcagtccggcgtcgtgctcgcaaacagcgtaaccgttttcacggagaaggccgtttgccgagataaatttcagcatcgcggttagtttttgctttttgtaaggcgggtcgagaaataccgtatcaaaggcaagcccccgtttcgccagcactttcaatgcacggccggcatcgttccggtatacttcactccggcctaaaaattcgcatttttccaggttggcccggacggtttgcagcgcctggatctccttatcaacgaaaatcactttctccatacccctgctcaaggcttcgatcccgagcccgccgctccctgcatataaatcgaggcccaggcctttttcaaaatacgggccgatcatattaaaaatcgcttcttttactttatctgtcgtaggcctcgttcccattcccggaacggcttttaaaacagtgcccttttggctgcctgaaatgactctcatgctggtcaccacgtatcatcagatttccatcttatcctaccatattttccggccgggtggaaaagtttttcaccaaaatttaaagcaaaagtataattcaggaaaagttggccataatgataccagcagcatcaaaagatgttgctgccaaccgcggagaagacttacgtttccccataagttcttcctccggtttctcctctccctttgccttctgtccggaataaggatatagaagggccctgcagtattggctgcagggttttttattttccgcatctaggccgggcacgtcgtttcaaaaagccggccggcatctcccccggtttattttgcagaaatactttccgaataaaaagaagtgcagtagaatagaagcagcaaatttgtttgtaagcgaggaatgaagatgcaacaaagatttattgaactaggaaacggatatacagatttatttgaactgatcgaactggcaaaagcaaaccggcaccggctgcacggcatgcttgcccttcataccatcgttgcggatcaagctgtcacttcgcccgtgctcattttaaaaccgaccgatccgggggaatttcaggcgttatacgtttgccttgaagggattccggatccgagggtgcagccaaacaaacggtacagcctgtttgccgaaaccgcagctgctttaggagcggacattgtggaactcgaagtccggccatcttcgtctttttccgacaaaaaccttttttatcaatatttaatcggcatattaagaatgaaccggctgattccgccgctgcaataaatatttcggccagagtgcagccggatgtgcttgatttaaaatgcgcgggacggagcttccgggcagcaacgcttttttgggcacggcggatttgcggtgatgcacacgcagggaatgctagcatgcaaacccggcgcctttatagccctattttataatcgtattcttttgctttgtccggttttgcgttttcatattccgtttttaaaaacggcttcatggaataatccactttccttacaaacggaagattttcaattttcgcttttacctgctctatctctttgcggtcacaataaaggacggcatacttcatcctttttgacgcataatggacattgccaaatcttcgtaaatgtttcgtatgcttcatctgatacagccaaatgatgaggccctgccgatctgataacatagcgtttccccttcgtgctttttttaatgagtgtaccataccttttttcacggaacaataaggaaaggccgcggattgcggccttatcacgatttatgcggaacagctgcagctgccgccggttccgcagccgccggaacaagaggcatcaaaaaacggatttccggtcggcacttttatatgttcagaaacagatttgccaatcatcaggctgatttggtcgagcagatcctggagggcattttccgcccgcctgaatcttgcgacgttctcatccagatccatttccctcttggcttcccttgtttctttgttgatgcgtttataatcagggtgatacctgccaaagcgctggacttcctcaaactgttctttcaggcgtgcaaatttccggattttctgctgtgtggctggatcatgatacatcctgttatagcagtcccggtaattttcggcaatatccgaggcaatgaccattttcgccagtgcttcagcttcagacaaaatttccgcgctttccaatgttgcaagcaaaaagctcacctccacatgatgattttaccatgtttccgcaagctttgcgaatttgcccgatcagctgacagaaatataaaactgcctgtgaatgcctaggcgggcgcctgtgtttttgtccactacttccagctgcactgtatgtacccctttatcaagcccttttacaacaaatgcagccgtattgtactcgcctttccatacaccatccacatagactttgatttttgccggtttggcatgccggctgcctgaaaaggtgacgcttggaatcatacattccacaaacaaatcccgatcttttacaaaataccggactgatgcctggttttctgccgcggaagcagcatccgcttcccgctgctctttacgcggcatatgcccgctgcagccggcaaacagcaaacatacagcaaggaatcctgcagccatcttcatttcgatcactccttgcggttattttccgcaagaaagcgctgatttactcaaaaaaggcaaattttttcggaaatcatccttgttcatagatggactgcaccatatgcatcatcatttgtgccatttgcaacccgtttgcaaacttttcaacccgctgcgggatcgttttctggtaataatggagcgcggcaatttgaaattgctccagttcctcgggatgccttgacaatttccggtaccacgccggctgctcccttaaaaaagttttccattcgttcgactgccggatgacttccattacttcgttccgcatatgtgcagcccctctctagtcttttctgaatgaaaacgggcccttcggctggggagcctgggattgtggcgtctgcccccctgtaaactgcgtgatcacattttggacggcggtaatcgcttccgtcaaatgctgcaggtggccttggacctgtgctgggtccaggttctcgagcatcgcgccgagctggttcagccagctgcttctcccgcccgttttttccttcgtttcactgccttctgccgcgtatttttcccagaccgggtcgtcttcgcccagtatataccattcttcaaagaaatcctgtaaagacttttttccgccccggacttcttttaaaatcaaaggatgggtttttgtaaaagctttaaacttttctacggaaggatgcaattttttcgttcccatttccgctcaccccgcgagaaaacatttttttcgaacgttggctttctgttacgttcacataccttcctcatatccagcatatgccggcagtaagcaggtgtgaaggttttcatttcccgtgaattttgatacgatatgggtatgcttttaaaaaaacgcgttaaaagaggtatcaggagatgaaagaagaaatacaccatacttttgaaaaagtggtccaagcggcaacggaagaagacttaatcgtattgcagcaaatgttaaatggactttccaataaacaagccgggaacgaacgtacatatttcaaggatctctttttgatggaagcggacttcgatggggaagaatgcgaggtgaccattccagttacgccgttactctacaataacttttccatcgttcacggcggtgtaacggcaaccctgcttgatacagcaatgggcgtgatggcaaatcgcctgttgccggcgggtcagcaggctgttacatccaatctcaccattcattatattgccccggggacgggaagccgcttaaaagcgaaggcaaaggtaatccaccgcggcacgcaaacgatggtgctggaaggaactgcctttcgggatgacgggacaaagatcgcccattgcacgggttcttttttcattttgaaatgagaagccggaaataccctttcaaaagccccgggcagcccgcctgccttatatgcatacatcagccggacccctctccagcttaggctggaacggtatccggctatggtgccttcatgaaatcctgggtatagtatttctggtacaccccgacgccaagatgggtgaaatctttctccagcaatgttttccggtggccttctgaattaagccatccctccacagcagccggaccatccgtatagtgggcggcaatattttccccagccgcagcataagaaacatgcccattctttaatctttcttttaagtctccatatttgggggagacatgcgaaaaataatggtcgtcagccatgtctttgctgtgattgtacgccacttcggaaagagctgtattccaggccagtttttttaaaccgaatcgtgccctgacaatgtttgtaaggtcaaaaatttgcctggcgttcgccttttctacgtcaacccatttcggatcatcctccggaacggattcgggcagttctccgtggtacaccatttcatatggatgcagcatcgtcagtgtgtttttatccataaaacggataaacagcaatttgccgctgaacttatcaagcgccagctgggcatagatatccccaagacggacaagcgggcggatattcaaatcttcttccgacaattcaaagcggtatgtgccttcatttgtttgcaccgtcatatccgtatccattaaaatggaactgtaaattttttctacattttctccaatctcaaacggggctacgtctaaacgggttccgacagcgtaaatggtcgtaaccttgccatttttcacgccggcctgaaaataaccggtcgattttttcttataaatccaccaatcataaccatatggagacggatccaccctttgtggttttccgaaatgtgtggtcaacgttttcacaggtttcccgatatataccgacatgccatgatccggacggctgtacgtttgatccttgctgtggtcatgaatgtcagaactgttatccattttcttgttagaggaatggttttgcagtacgccgttttcaggacgaagctggacataaagtccgatcagaaatatgatcacaaggatcgcggctgtttttaaaaaggtacgcaggtgacttcacctctcttgatgttccgtaaattttttctcctttaattcattttattatatattttacagttttaagcagaaaagcaccaattttttcaatcacctcctcgaagggcagccggtgcggccggtttttttgcgggtatgaacatttgcattgcataaatgtttgtattcagataagataaaattgaaagattttaattgcgcggacgggaggggtatttttgcggtttgatgacacgggtttggaaaatatgaaagtggatctgacgcggctggatgatgtaatggagcggcacaagatggtacgtgccgggcaatgggattatgaacgcgtcacatatgatagaaaatttacgattcaggaaggcacctattatcttcgcgtgcagggagttgcaaccgagggggatgtggattcgtttgatgccgtgattcagttaaaggcgcctattttaggaaaatattattatccgcatggtgtggaatacggcgatgacgagtattttccgcatgatctcgtcaagtattgcagaaaaattttggaagcgcttaaagaagacttggttgtatttgctgaataaaatgtgccgctcctgtggccccttaaaacggtgggccatagagagcggcctttttttaatgctgttccattagcctccgctgttctccggcaaccggattcttttccgtactgccatcttcctgttctgtccttgcccattggaaaaaaatgcgggcaagcatgatgccgtagacgatttcctgcatgattttcatcaccacaccgccaagctgctggtcctgcagtacaggaagcggtgagaaaagtgccggggagccgtaacgcgccactccggagagcatgtcagcaggcacacataaatgcatggacgaaagccacatcgttccgtcggaaaagctcctgtaaaccggatgattggcgaacatgattaaggcgcatgcaggggttaaaagcatggcgcttgcaaataaataagcgatttttttcaggccgcccagcgcatattgcccgggcaatggcgacaaaatcggccaccacatcgctatggctaaaagaaacagcacaatggtgtagatgctgtggagaaacggagtgaccttgacctgatcgaaaacggccggaatgtggtacagggaaaaaatgatattaaaggtgataacggcaagcaccggatttgtaaagaaccggacaacgggcgcgacaaccggaagctgcatccccttttccaatatccacaccggcatcccacgcaaaaacagcggtgcgacaatgaaaaaaaggatagacatttgcagcatatggacggaaaacaggatatgcccgataagatcgacaggagagcctttgacgatgtaaagcaataccatcgctgtacaaaaagaaacagactgcaccggactcggcggcattgcgttcaaataagaccttttgcataaggacgcaagcagaaaataaagaaaaacaaacagtaagatcgtgataaaaaaataagggctccacagtgcacgaaatccgaatatttcaagcggcaccattaccactcctttccgcaccattgcaaatcgatttaaagcgggggcgtccaagaagcgccctccgctttacttttagctctggctcctaacagccgataatcaaacgccctccgcttttctttgtctagctgcggctcctagcccctcgggtcgaataacccgtccgtcctgaagccaaggcttcatcccggccggaacattcgcctgtcggggctaagcagtcgcctccgcttttctttgtctagctccgggcgctgtcggctagtgaatttccagtcccctcccctacgataagtcaacatcggctcgttcctcgccgtgtttcctttatctcagttcggggactatgaaattcatacgccgacgggcaaacgccctccgcttttcttttcaccaccagatgatggtgaggaatgccagtactgtgacaaatgcgacgagtgtgccgccaaagatgaaaagtttcgggccttcatggtgcttatggttcatatgcatgaaataaaacagctgaaatacgacctggatcgcagccaaaagcaggataaccggaatggtaaaccatttggacaaatgggcatggacggcccagaatgcaacaatagtcaaaaacatcatcaaaataaaactgacgacctggtacttcatttcctccgcgcttttgcggcgcctgtattcgtattcaacatggcgtctgtccatttgtgcattgtgttccatcttatcccaccatccccatcaaatatacaaccgtaaagataaacacccagacgacatcaataaagtgccaatacaggcttgccacgtaaaatttcggcgcattgtacaaattcaatccccgtttcgcgttccgcaccatcagtgtcgtaatccataacagcccgaacgccacgtggccgccgtggaacccgacaagcgtataaaacgcggaaccgaatgcgctgcttgtaaatgtatgatggtattccgtcacataatgatggaattcatagacttcaagcccaagaaaacaagcaccaagcaaaacggtaatcaaaaaccaggcctgcatttttttaaaagcaaaatttttcatatgataaatggcatacacacttgtaatggaactcgttaacagaaaaaccgtggccaaaaaggttagcggcagttcaaataagtcttttgcatgcaccattgatgccgggcccttgtctttcagcgccaggtaggttgcaaacaaggaagcaaaaaggaccgtctcgccgcctaaaaacagccaaaaaccgagaaatttattcctgccttcaagcgtcgcccgctccggggactctggccatgttttcgccgtaaaattttgttctatttccattacgccccggcccccctttcttcgcgttccattaaggcttccttcctaatatggtatcccgtatcatcttttaccgaccggatcagcatcgatccaagggtaatcgccaagccgatgacaaggatcgtgatgccggctttggtatggtttgcatgatacattgcgccgaacgcggcaataaataaaccgaatgccataaaaaacggcaagatggacgagttcggcatatggatgtctttgatcggctctgctggtgtcacctgttttttcccttccattttttcgagccaccaggtgtcaattcctctgacaagcggtgtttgtgcaaagttgtattccggcggcggagaggaaatcgaccattcgagcgtcctgccaaactcccacggatcgtttccgactttccggttctggacggccgtgacaacaatattggccacgaggattagcacacctgccgccatcaacaccgcgccggatgaactgacgaggttatccgtatcccagccttgattcggcagatatgtccactgccttctcggcatcccgagcaatccgagccagtgctggatcataaaggttaaatggaaaccaatgaaaaatagccagaatgtgattttccccattgtctcattcagcatcgtgccgaacattttcggccagtaataatgcagtgccgcaagcaacccgaaaacaacaccgccgacaataacatagtggaagtgggctacaacaaaatagctgtcatgatattggtagtcagcaggtgcagccgcgagcatcaccccggtaacaccgcccaatgtaaaggacgggatgaaagcagccgcataaagcatcggcgttgtaaaccggatgctcccgccccacatcgtaagcagccagttgaaaattttaatgcccgtcggcaccgcaatggtcattgtagacacggcaaaaatggcgttggctacattgcccaggccggttgtaaacatatggtgggcccacaccataaagcctaaaaacccaattaaaataacggcgaataccatggaagagtatccgaataatcgctttttagaaaaatgtgcaaaaatttcagagaaaatgccaaatgccggcaaaattaaaatgtagacttccggatgcccgaaaatccagaaaagatgttcccaaatgatggtatttcctccgaaggccacgtcaaaaaatttcgcaccgaacatccgatcaaatgttagcaagaacaaaccggctgtaagtggtggaaacgcaaacagaataagggcggacacaacgaaagtcgtccatgtgaacatcggcatgcgcatgtacgtcattcccggcgcccgcatgttcataatcgtcacaaggaaattcaccccagcaatgagcgtaccgaaacctgaaacttgcagcccgagtgaataaaaatcaatcccgtgtccgccagatgcgagggacagtgaagcataggaagtccaccccgcatcgggcgcgcccccaagaaaccaggataaattcaagaaaataccgccaaagaaaaacaaccagaaccccaatgcatttaaaaacggaaaagccacatcacgggcaccgatctgaagcgggacaatcgcattcataaaaccaaacaagagcggcatggccgcaagaaagatcatggtagtgccgtgcattgtcatgacttgattgtacgtatccgcgccgacaaaatgattgttcggcaccgccagctgtatgcggatcatcagcgcttcaatcccgccgatgacaaaaaacaatccccctgtaatcaaatacaaaatgccgatttttttatgatccactgttgtgagatattcatagacagtggcgccaaaacctgccttttttgttcctacgctcactttaacctcccctttgctttcgaatatcccctttgttttattcaccagctttcaattgcatcaaataagccgcaagcgcatcgatttgccggtcggaaagcttatccccgaaggcgggcatttttgtccccggtttgtatttctccggatcttttatccagtttttgagattggcctcattacggtccaaaatgccggcgactttttccctttcgccaaaggttgccatattgggagctgtccgtgcctgttccggccgtgtgtcattcggcgtgaccgcgtggcagctgatgcagctttttttgaatacatcctgcccttcctgtgcgagagcggacgccggttttgtttcttttgcatttttcatattgctgatccacgccttaaactcatcctgtggcaccgctttcacgcggaagtccattaaggcatgggaagggccgcataattcggcgcattttccataaaacacatttccggcatcctctgccttctgatcatcaatttcaagccagaatttgttgatattatctgtgttggcatccattttcccgccaacggacggtatccaaaatgagtgtttcacatctgaggctttcacttggaagtaaactttctggtttgttgggacaacgagttcctggcttgtcaccacaccataacccgggtattcaaattcccaccaataaaggctggcgcgaactttaacgataagcgccccttgcttggcatcctttttcttatccatcgctttcgtatctccgaggctgaagacctggctgatggtcggaatggcaattaaaatcaataaaacaatcggaataatggtccataagatttcaagcttatgattccccggcacctgttttggaatggattcgtccccttttttccgcctgaaccgtatgagaacggtaaggaaaacggcgaatacgacaaccatgacgaacaccataatccaaacgctccacatcatcaaatcatactgcttccgggccacttcgccggcaggatcaagtgccgacaaatatggcttgccacagcccgaaagcgcggccataaacaaagtgacaataaaaagcaaactccccttttgcagccgctgtttcatcgctctaccaatcccctctttcctgtatctttctgtcagaacaaggatgcaatctattggatttcttttgcaagaaagaactccctttagaaaagcgtagcgattaccattgctacaaacaagatcgttaaatagttcagcgaataaatgaacatccatttcgcccattttaaatcattcttcattttaaaaccggacaggcttaatgccagccagcccagattaaacaatgtcgcaaggatgataaaaccaatgccgagcggtttcaggaaaaacggcaccggaataagcaatgccacccatatgagcatatgccattttgtgatttgaaaccccttgacagccggaagcatcggaatgcccgctgccttgtattcttcgcattttttcatcgcaatcgcataaaaatgcggtggttgccagataaacataagcaaaaacagcatccatggcacaatcccgagatgcgggtcaacagccgcccagccgatcagcgggggaacagcgccggcaaaactgccgatcacggtattgctgacaagggttcgttttgaccacattgtatacagcacgacatagctgaatacgccaaacagcccgatcagccccgccattggagtggtcataaacaatagcagtgtgccgagtgccacaaatccgaggccaattgtaagcacttttgcgtttgaaaatctgcctgtaaccgtcggcctgaaatttttgcttttcataatgacatcaatatcccggtcataccagttgttcaggctgcacgacccggcgacaatcagcgcagttcccgccatcgcaagaaccataatgtccagtgactgtaaaaaatgcctgtttgtcaattccaaagcaagccacattccggtaaatgccgtaattaaatttgagtttacaattccaattttaatcaaggataagaaatctttcaacgcagaagcgtctgcagcttttacccttgttgttgtatccatcgtccgactatctgccacgatagtccctccttccaatttttcaaaaccgttcaaaaaaaatggcctgacacgttgtcggcggattccttttgtaaatgtttttacgctgccaataaggaaaacggtatactacaactataatccatcttttcctttttggctattaatcaaaactgtatgtaacgatatcgtcatactaagatcatttataagtttcccaacatgtaaatatgcggaattccgaaatatacctgcctatattctatttaatcataaattaccgcgaaggtgtgatattttcgacacatttttatggcaaatttgtgtcatgggaaataaatatttttccttcagactgttttacgataagatgatagttggaagcaccttgccgaacggattttctactatatgaacggttgcaatgatgcgggactgtatgttgcattcgtggcttgtgatacatgtttacaaatgagattaaagaaggtggaacaattgcgcacaactttaaaatggctcggagtagtgacaactttatcgatgatggtggttttaatcggcggggcacttgtcaccaataccggttcaagccttggctgcggccgccaatggccgctttgtaacggcaaaatttttcctgatccgctcactgtcgagtcgctgatcgagtggctgcacaggttttgcacgggcatcgcatcgtttcttgtctttgcgcttgccatttggtcatggtttgcaatcggccataaaagagaaacgaaatttttatccattatttccgtcatttttctgcttctgcaggcatttctcggtatggcggcagtcgtctggggttcatccgatcttgtgatggcgcttcatttcggcgtttcgctcatttcgtttgcgtccgtgctgatgctaacgctgatggtttttgaatgggaccagaaatttgacgcaggccggcttgtccttgaaaaaagcatgagatggcatacgatcggcgtgaccgtttacagctttatcgtcgtttatacgggcgcgcttgtccgccatatgaatgcaagccttgtttgccgggatttcccgctttgtgtgaacagcgacccttccttgcccgcaaaccggttcgaatgggtgcagatggggcaccggacggcggcactcctcatctttgtctggattgcttatatcacctttaaagcggtaaggcattatcaaaaccagcgcgttatttactggggatggatcattgcgttcgtgcttgtctgcctgcaggctgtttcaggcgccatggtcgttttttcgaggatgaatcttactttcaccctcctgcacgcatttttcatttcctgtctgttcggcctgttatgttatttgaaccttgttgtcgggcgagtgaagcagtttgccaaaagcaaagacagcctcccgctaaaaaaagcccgggttcgctgagtttggaaaaaccaatggtaccgcatgttgcggcttggtgcaaaataaggcagcaaagggcttacgtaagataggcggaaaaggcgcaaggcataaaaccttgcgcctttttattttatcctctgctttcactctgccgcgcacccgtttttaaacgttacggccttgagtagacctgatacggcctccggtttgctccgcccgcttcctgcggcttttcctgtttgtgtttatacttttcctcatactttgtaaacatgcccacattgaccagaatgccgagggaaagggacaaaatcagaagcgatgaaccgccgtaactgataaacggcagcgtcacccccgtaattggaatcaggccgcagacgccgcccagattgataaatgtctggatggcaatcatgccggaaattccgatcgcaagcaggctcccgaactggtcttttgaatggatgccgatatatatgccgcgcagcacaatgtagcaaagcccgccgatcacaaacaaaacgccaaaagccccaagttcttcggcaataatggccataataaagtcggtgtggggctctggaagataaccgagcttttgaatgctttccccgagtccctgccctttcagcccgcctgacccgatcgcaatataggagtttacgagctgaagaccttccccgccttcgttctgaaaaggattcaaatagcctgtaaaccgtgcgatcttaaccggtgtaaagattttgtccttttccagaaaaagaaacggcgacaacagaacggcaaatagaagcccgagccctgccagcttcagcatggttttcaggcgcatgccggatgcaacgatgatcgtgcagccaatcccaaaaatgatggtcgccgtcccgatatccggctggatcgcaaccaggaaacaaacaacgataagaaagataagcggcgggacaacccctttgttaaagatgtcaatgtatgcctgtttcttggcataaacggcggacagataaataataatcgcaactttcacaaattccgacggctgtacggaactggaaccgagccggaaccagctttgcgcgttattcgacgtatggccgaaaataaacagtgccaaaagcccgaacatcgacccgcacatcagcactgcaaggaattttttgctcgcgtatagtttatacgggagaaaagccgtaacggtaaacgcaaggagtgcaagggccaaattgattttctgcttgttgtaaaaataggcgctgtccagcccgtaacgctgcactgcaatcaccatgctggaactgtagatcattaccaaaccgaataagcaaagaagcaggtagacaacgatgaccgagtagtcgaatgattttaagatttttttcagcataggaaccttccaatccgtaaaaactgcaacattcatgataaaaaatattctaccgttttaaaaaaactcctgccgttatttttaaattataacatctttttcgccggccgccattacctgacccttattcaaaaaataaaaaactcaaacaaccggaacatcgtttgagttttcaacattatttttttatatatgcatcatgcaaaagggacagttcctgttcaagcgaatcaagaagccgctttccgtcaccggcatccactaagccgagccggaccgcaaaatctatttcacgggataaaccaaacatttgtgtatccaatacttcctcgtataaagggcattggggcatcgttaagttatccatttgaacctgaattaattttaatatcttttctgcgtccgccttgagcaggctgtatgctttctcccggtggttcacctttgtttcagacgccaaattgatccccccgttcacatatcaatctaattaaaaattgtacctttaaaaccgtgattttgcaagttatacgaaatcaataaacgcccggaatcccgtaaacaagcgggggagacagaatttgaaattccgcaattccccgaccccgaacgctttccggactgtttttatacgctttcaagtgacacgggcagccgtgaaaggtataatgctgtatagacggacagaaaggggccacaatcatgattatgcaaataaagggaaaagtgaagtttccgattacgctagatatcggcacttggatatttgatgaccggaaagtcgatcttgatacatatttcgacgaagaaaagcaggaaaccagccaggaagaagcctacttaaagaaaaccggcaaatattttgacaaagccatggcagaaggggccgatccgcaggctgctgtaaggacaaagtcaaagtttaaacggcaccatttgaaaactgggacatttggcatcccggtcggcctgttcattcaaaatgcggagccgctggaagatgcggaaaaaatcgtgtttgaaacaaagaacgggcctgtcgcttatccgcttgaaatggctggccatttaattgctgccttttctattaaaggaagggcgctgaaagaagacggcccgcttcacattttattggatgacggttcaaaccgggaaaacccggtcaaatatgtaaccggtatgcgcattgaataatcccggatgccgggggcagcataaacgttttaagacagctgctcccggttttttcatatagtggtcttacaaaaggtctgccgcgatttgcgcgagttttgagcgctcgcccttaagcagctgcacatgcccggcgagcggcacatctttaaatttctcaacgacgtacgtcagcccgttattgtaagcatccaaatacgggtggtcaatttgttccggatcccccattaacacgatcttactctgttcccctacccttgttaaaatcgtcttcacttcatgcttggataaattttgcgcctcatcaataatgatatattgctccgggatgctgcgcccgcggatatacgtcagcgcctccacctcaatcgaactcatgccggacaatatgccatcaatttctcccgcttttttcgtattaaacaaaaactcaagattatcgtagatgggctgcatccacggccgcagcttttcctctttttctcccggcaaatagccgatatctttgccaaacggaacaatcggacgagcgaccaaaagctttttataatcatgcaaatcttccgtctgcatcaggcctgcagcaagggcaagcaatgttttgcccgttcccgcttttccggtcagggtgacgagcggaatatcggggcgcagcaaaagttccattgccatccactgctgggcgtttctcggcttaattccccagacagcatcctgcacatgaaagagctttttcgccgtttttccagcctgatccacaatggcaattgcggaagccgagctgccgagcgcatctttcaaaatcagaaattggttcgggtagaacgggtggttggcaatttcgctcagcgacagttcctgcttttcataaaaccgtttcaataaatcggggctgatatacatttccatttgcccggtataaagatgatcgaggcttacgacacggtcgtttaaaaaatcttccgccaacaggccgagcgcgtccgcttttacccggacgagcgcatctttgctgacaagaatcaccgggcggccattttcttttctctcttcttccagcgataaatttttcgcaaccgcgaggatccggttgtcatttgttttttccacgaaaatatcctgcagctggtgaaaggagcggtgattcagctcaattctgagcacacccccgttttcaagcgggattttctcatgcagttttccggcttgccggaaaccgtccattaatttggatacctggcgcgcatttctgccgatttcgtccatatttcgttttttagaatccacttcttccagtacaacagccggtatgacaatttcattatcttcaaaagaaaagatggcatatggatcctggagcaatacattggtatccaagacgtatattttcttcaaatcgatgccccctgcttcatatggattatgttagtttatgtgagcgcggtgtgacctgttcatcgctgggattggacaaaggaccaggcactgctaaagtatatgtacgggcaagtccggttagaatcattgcgcgcgtccagttcttttgcggcacaaaaaaaagcttccggaaccggaagcgtgctacattggaaaacgttcctttttttcagtttttttatgctgatacaggcggattttgtaaacgccgagcacaacagccgctaaacagagcgactcccccacgggcaaaaagatggcaaaaaacgtgagcagcgtgcatcccaaaaggagcagtacataaataacagcagatttcagaactggcaactttctcgcaaatccgagccggtagacaatgaccgaaagaacgacgatggtcagatacaaggcccacatccccggttccgggttttcatccactttgtacaacgccgcaaaaaatgacaattggtggtgaaccgcctcgcttgtcatcctatctccccttttcccctttgaatatatgaaagaacagggtcatgccggccctattctttgcttatgcattctctgctgcttttgcccgtttctgcgctttttcgcgctcgctcttattcaggatttttttgcgcagccggattgattctggcgtcacttcgcaatattcgtcgtcgttcaggtattcgagcgcctgttctaacgacattatgcgcggctttttgatgaccgccgtctgatcttttgttgccgagcggacgtttgtcgcgtgttttgctttcgtaatattgacagcaatatcattttcacgggagttttccccgacgatcatgccttcataaatgtccgtgcctggctcgacaaacagcgtgccacggtcttccacctgcatcatgccgtatgtcgtggctttgcccgtttccatggagacgagaacgccgtttctgcggccgccgacacgaccagactgcattggctggtaggaatcaaacgtatggtttaaaatgccgtaacccctcgtgagcgtcataaattcggtcgtatagccgatcaatccgcgggccgggacattgaaaatcaggcggacttgtccatttccgttattgatcatatcgagcatttcgcctttccgggaaccgagcgactcaataatcgcaccggtgtgttcttccggtgtatcgatttggacacgttccaccggttcgcatttgacgccgtcgatttctttaatgatcactttcggttttgaaacctgcagttcaaacccttcacggcgcatattttcaattaaaatggataaatgcagttccccccgtccagatacaacccatgcatccggagagtcagtgttttcaacacgcaagctgacatccgtctgcagctgcgaacggagccgttcttcaattttccgcgccgtcacaaattttccttcacggccggcaaacgggctgttattgacaaggaaagtcatttgcaaagtcggctcatcaatgcggagtggcgtcagtgcttcctggtgttcaattgggcagaccgtctccccaacattgatgtcttccattccggacaccgcaattaaatccccagcatatgcttcctcgatttcttcccgcttcagcccgaagaaaccgaacattttggtgacacggaactgcttgacgctgccgtccagcttcatcaatgccacctgctggccgacatgcatttttccacggaaaatgcggccgatgccgatccgcccgacataatcgttgtaatcgagcagggcaacctggaactggagcggttcttcgcggttgtcgacaggtgccggaatatgttcgataatcgtatcaaacagcactttcatattttcttcctgtttggccggatccggatcgaggcttgccgtcccgttaatggcggaagcatacacaaccggaaattccagctgttcatcattagcatccagctcaataaataattcaagcacttcatcaaccacttcttcagggcgtgcaaaatcgcggtcaattttgtttacgaccacaatcggcgtcaagttttgttccagtgcttttttcagcacgaaacgcgtctgcggcatgcagccttcataggcatccaccacaagcaagaccccgtccaccattttcataatccgttcgacttcgccgccaaagtcagcatgtcccggagtatccaaaatattgattttcttatctttataatgaactgccgtatttttggcaaggatcgtaatgcctctttcccgttccagatcattggaatccattgcacgttcttcaacatgctcattggcacggaaagtaccggactgcttcagcagctggtccacaagtgtcgtcttcccatggtctacgtgcgcgataatggcaatgttgcgtaaatcttctcttcttttcaaaaacatttcctcctgcctaaacgcaaatctatgttagtctgtacctttaactaaaatattataacacaatgctggctttattaaaacattttcgctaaaataaggggagagggaggttcatcatatgcgggaaatcaaatgggtatttgtgttcttttcactggctgcattcctttccatgtgcggcatcggcgttgcgatcggcgcccaaagcgttgccggcattctcggttgcaccgcgcttctcattgtcattatgggattcggctttaaaacaaagaaaaaaatgcgtgaagaggggaaactgtgagcccctcttttcttattcctgcccttttagataccgctttaaaatttcctcatgcagcccgggcttgccggcaaacacggaactgttcccgagcatatcgagcgggcgcccgaaaacatccgtcacaacgccgcccacttcttccacgatcactttcccggcggcaaaatcccacggcgacaggcgcatcgtaatataagcatcaagccttcccattgccacataagcaagctcaagcgctgccgacccgtaactccttgtgccgcgcacatccctgacaagcgctgccagacgggccgggtcgatacccctgttttccaccatgcaatacggattcagcgcaaggatcgtatcttccagcctgttttgcgcaagtaacggaatccgttccccgttaaaataagcccccttgcccttttctgcaaaatacaattctttccggacgacatcataaatatagcccagtttgccttctccgttctcgtagaccccaatggaaatcatgaaattgactttttggtggacaaaattgaccgtcccgtcaatcggatccacaatccagaggatgccttctgtatcacgaatatcctcaccgaagccttcttcacccaaaatgtggtgatccggaaaggttgtccggattttgccgattaaaaattgttctgtttccttgtcaatattggtaaccagatcattgcggtccgattttgtttcaatttgcagcggtttttgcgaagcaagaatccgctcgcccgcttccctgatccaccggacggcatatgtattgatttcttcccatctgtccatagtcgggccctccatctatgcaaatcatttcccttaagcgtaaaggaaataaagacaattatcaagttttgagaatgcgtccgaaatcgttttcccatagcggttttgtcagtaaagatgaacctctcctgcacaaaaacgaaccccatctgtatccaatacagggagtccgctttcaacgacatcctgccttttcgttccattacatggctttcattttcagcagttcttcacggattttttccagacgcttaatcgactttcctttttgctcttcatctttcatttccatcgcttcatataacgtagccagttcgtaatccagttccatgcgcaatactgcaatccgttttctttcataaggttttcttttcaccgaagagattacttgtttcatttttcttcacatcctcctggggtaatgatatgaattttctgatattatctttatatatattatgtgtaatctcgattgatgtaacaaaattgtgtgtatacctatttttacccaccggcttttatttgttaaacctccctgatggatgataaaatatgaatatccccatggttcatacagaacggaggtgaacaaatgggcatcactgcttttactggacaggattttgacgttttccggatcgaaggcctcgatcagcggatggaacagctgaaatcaaccgtccgtccgaaacttgaagtattgggggagtatttttcgccggttttgtcggttttgaccggtgaagaaatattttatcatgttgccaaacacgcccgccgtaccgtcaatccgccgaaagatacgtgggtggccttttcccctggcaagcgcggctacaaaatgcttcctcattttcaaatcgggctgtgggaagaccggctcttcattgtcacggccgtcatgaatgagtgcccgcaaaaagcgtccatcggaaaaaaactcgaaaagaaaattgatccgattttagaaaatatacccggccattacatttggtcggatgatcatacaaaaccgggtggcatccgcactgaccgtatgaatccccatactttaaacacgtttttcagacggatgcaggttgttaaaaaagccgaaatgctttgcgggcttgagatcccgcgggaagaagcagccggcatgtccccggatgaactggccaaaacgatcgaggacgtctttgtacatgtattacccatctacaaaatggcctaaacagcatgcagagtggaaaaaagcgcgccggaacacggtgcgctttttctcctgtgccgattcgtaatttgcagacaatttaaaagcagcatcagcgggtgatgctgctttctttccgtgccgctaatcgcgcgatccgtttttatccattttaatgaccggtccctgctcttccttcattttcttgatggcccggtacggggaataaccgctcgcctcttcaaattcattgcatatattccgctcatccgccttcccggggacgatttctttaaaacggcggtacctggcaagcagcacatcccggttgacccctttttcatatgcttcttccaccgcttcgaaaaattgaacggcgtcgatgacttcctgtgtcgaccagtcagctgaaatcggatatggatattccatccaaaccacctcgcttttcttctgtatacccgttctattttacctgaatcgcttccgcctggccaatgatgccgccatctgccggaatacaagggctaccatccgtttggtttcccatggctccccgccttgtacattcaccgtctagcttcccctcatttctccatgctttatgcgctttatctttttccattgcccgcatccggctttttttccctgtgcaaagaaaaactatttaaaaaccgtgtccggaatgctataattcatcttgtttttcttcaaaagcaagcaatgagataaagaggtggaatgattgtcacaatatcacacgccgttatacaccgggcttctccggcatattgaacgaaatcccgtccaattccatattcccggccataaaaccgggcgcgggatggatcctgattttcgcaaattcatcggcgacaatgtattaaaactggatttaattaatatcgagccgctcgatgatcttcaccagccccatggcatgattgaggaggcgcagaagcttgcggcggaagcattcggtgcggatgccacgtttttttccgtacaagggacgagcggcgcgattatggccatggtgatgagcgtctgcgggccgggcgataaaattattgtgccacgcaatgtccataaatcggtgatgtctgcgattgtgttttccggcgccgtgcccgtttttatccacccagaagtggatcctttgcttggcatctcacacggcattaccccggcgtccgtttccaaagcgctcaagcagcatcccgatgcgaaagccgttctggtcattaatccgacctattacggcatttccgctgatttgaatagcattgtggatatatcccatgcctgccatgtcccggtactggtggacgaggcacacggtgtccatattcattttgacgatgaactgccagtttccgccatgcaggccggcgccgatatggccgcaacgagcgtccacaagcttggcggctcgctgacgcaaagttcgatcttgaatctgaaggaagggcttgtatcgaaaaaacgtgtccaaagcattttcagcatgctgacgaccacgtccacttcctacattttactggcttcgctcgatgtcgcccgaaaaaggcttgcaaccgagggaagcacgatcatcaaggaaacaacccgccttgcgcaaaaaacacgggagcggataaacgaaatcgatcatttgtattgcgccggaagcgagatcctccaaacgaaagcaacatatgattacgatccggcaaagttgatcatctctgtaaaagatttggggatcaccggccatgatgcggaaaaatggctgcgtgaaacctaccatatagaagtggaactctctgatttgtacaatattctttgcattgtgacgcccggggatacggaaacggagctggacttgctcgttgaggctttacacagcttgtccgacacgttctcgcatttgtccggcaaggtaggggtgaaagtgatgcttcccgaaattccatcgcttgccctctcgccgcgtgatgccttttatgccgagacggaatccattccgctttccggttctgctggcaggatcattgccgagtttgtcatggtctatccgccgggcattccgatttttatcccgggggaaattattacggaagaaaacattgcttatatccggaaaaacatcgaagccggccttcccgtacaggggcctgaagacgaaacattgcaaacgatccgcgtcattaaagaacatcatgccattcaataagtttgaaaaagcaggctggggccttcccgcctgcttttttgtcccatcacgcaaaaaaagccgggcaacaagccggccgagagaaaatggacgcatgcattggaaaaatcaagtgctacagttcaggactattcttcttcgtgtttacattggtcacacgttgagtaaagcacggatactttttcttcctcaacgtggtcaatcgtggcatcgcatgattggcaaacaatgattcccatccgattttcctcccctttgcgctttttgtaatcgcttgtaatattataatatgtcatactggagaaaaaatcaaggattttgtataacatattttaaattatgttatacaattgaaagcgaaatcattttgcggttgttttagaaaatcagttttgaaaatgacacttccacaagcccgtatacagcgagactcagcaccgttaccacagatgcagcccggagcgaatgcacaattgattttgccagggcaaaggcaatgaataaaaaaataatgaacagggcggcggtaaaaataactggatcgtgatcggacaaccactctgccagtttaaaaccgctccatatcatgatctggaataaaaatgccaccgtacatttcattgtcccacctgcacctttcatcataattcaaaatatgcacgcagtttcgttgttataaccttgcctgccagcacgaaaaaatctgtcccatatgcagttgttactgttatagccttatagcggcgcctttaaacggaaaaaggcttcacgccggggcagccttcccggtgtgaagcctttgaatcattattttaaaatatggactggggtgccgagtgccgcttcggccgcttccatcgtaatttcccctaatgtcgggtgggcatggatcgtcagcgcgatatcttccgctgtcatgcccgcctcgattgcgaggccgatttccgaaataatatcggaagcgctgatcccgacgatttggccaccgatcaacagcccgtcttctttgcgtgtaatcagtttgacgaaaccttcgccggcttcaagggcaagtgcccgcccgttcgcgccgtacggaaatttgccgactgcataatcaatgccctcttcttttgcctgctgttctgtatagccgaccgttgcaagttccggatcagaaaagacaatgaccggaatgccgaggtaatccacttcggccggctgcccggaaatggcttcggccgcaatcttcccttcataggaggctttgtgggcaagctgcgggcccgggacaatatcgccgatggcataaatattcggcacgcttgtccggcactgtttatccacttcgataatgcccctgtctgtcatctttaaattcaactgttcaaggccgagttcatctgtgtttggacggcgcccgaccgtaaccagcacataatcgccttccactttttgttcctggccttttgcttcatacgtgacaactacgccgttttccttctcttccacgccttttgccatcgcttccgtgataatttcgacaccccgttttttcagcttgcggacaacgagggaagtcatttgtttttcaaacgcgccgccgataatgtcttttgccccttccaaaatcgttactttcgtcccgaattttgcataggctgtcccgagttccattccgatgacgccgccgccgataatgacgagtttttccggaatttccttcaaactcagcgcgccggttgaatcaatgacgcgttctgaaaatttgaaggaagggatttcaatcggtcgcgaaccggttgcgagaatcgcatttttaaatgtataggtttgcgctgatttctcgtccattacacgaagcgtatggtcatcgacaaaataggcttccccgcggacgatgtcaattttgttgccttttaacaggctttctacgcctccggtcagttttttcacgacgccggatttccattcctgcactttcccaaaatcaatttttgcattttcaacggcaatgccgagcgcctcggattccgttgcgtattcatagcggtgcgccgccgaaatgagcgcttttgaaggaatgcatcctacatttaagcaaaccccgccgataaactgcttttcaacgatcgtcactttttggccgagctgggctgcccggatggccgcgacatatccgccaggccctgcgccgattacaattgtgtcggtttcaattggaaaatctcctacaaccatcagattacgcctccattaataaaagttctggatcatgcaacaaacgtttgatatgatttaacgcattttgtgcggtggcaccatcgatgatacggtggtcaaaactgagcgacaacgccagtacaggcgctgcaacaatttcaccgtttttaacgaccggcttttctgcaatccggccgattcctaaaatggccacttccggacggttgataaccggtgtaaaccattgcccgccggcggaaccgatattggaaatcgtaatggaagcgcctttcatttcgttcggggcaagctttccatctcttgctttttcagccagttcattaatttctttggaaaccgcaaataccggtttgcggtcggcgtgtttgacgaccggcacaagcaagccgcgctccgtatcagcggcaatcccgatattgtaataatgcttatggatgatttcattcgtttcatcatcaatcgaactatttaaaaccgggtattcccgcagcgtgctgacgagcgcttttacgacatacggcaggaaagtcagtttgatgcctttttctgccgcgatctctttgaattttttccggtgcgcgaccagtgccgtcacatcgacatcatccatcagcgtaacatgcggcgcggtttgtttcgagttgaccatcgcttttgcaatcactttgcggatgccgctcatcggttcacgtgtttcagggaattccccttcaggaatagcattctgggaagcaggtgcctgtgcttcggttttgccggtttccgcttccggctgctgcggcccgttcacatacgcatcgatatcttcgcggagcacgcggccgttttttccggttccggacacaagctggatatcgacacctttttcccgggcatatttccgtacggatggcattgcgatcacgcggcgatccgcggattcggagccatgttctgcttctttttcagcaggcttggcagtttcagctgtttcctgttttgccggttccggtttggccggttccggttttgcactttctgccgcctcttctttctgatcttgcccatgatcccctttaaatttaagattttcatatccgggcgcatcgaattttacaaggacgtcgccgacaactgcgacgctcccttcttcaacaagaatgtcttcaacagtcccttccacaggggacggaatttcgacaaccgatttgtcattttgcacttcacaaagcacatcatcttccgaaactttatcgcccggtttaataaaccattttacaatctcgccttcgtggatcccttcgccgatatccggcagcctgaattcaaatgacaaggtgttcacgctccttttttcaaaatgcgcccccatcaaggtgcagcaaaaaacttgattggaatgtatctcggttcaacgcgccgccatcacccgtttacggcaaaaaccggtttagaatgtcaatgtctcttttgctttttccaaaatatctttataggtcggaatccaaacgccttccgcctgcgagaacggataaacggtatccggcgctgttacgcgcaatactggtgcttccaggctcaaaatcgcgcgttcgttgatttccgcaacgacgtttgccgcaacaccagcctggcgctgtgcttcctggacgacaatggcgcggtttgttttttccacagacgccacaatcgtttctacatcaagcgggctgactgtacggagatcaaccacttctgcggagtacccttctttttcaagttcatccgctgctttcaatgattcatggaccattgcgccgtaagcgataatcgaaatatcttttccttcccgttttacatcggcttttccgagcggaatcgtatattcttcttccggcacttcttcccggaaagaacggtacagtttcatatgttcgagaaaaacgaccgggtcattgtcccggatcgcggagataagcaaccctttcgcatcataaggcgtggacggaattacaactttaatgcccggtgtttgcgccatgagtccttcgaggctgtccgcatgcatttccggcgtatgcacgcctccgccgaaaggagcgcggatcgtaatcggcattttcaaatccccgccggtgcggaaccggtatctcgccatctggccgtggatcgagtccatcgtttcaaaaacaaagccgaaaaactggatttcaggaaccggccggaacccttggagcgcaagcccgatggcaagcccgttgatgccggattcggcgagcggcgtatcgatgacgcggtctttgccgaactctttttgcagcccttccgttgcccggaagacgccgccgtttacgccgacgtcttcaccgaataccaaaacattttcatcatttttcaactcggtcctgagcgcatccgtaattgcctgtatcatcgttagttgggccatggcttatttcgactcctttgcttggtaaaattcgtattgttcctttaaagtttgcggaagttcttcgtacatcacggagatcagatccgtcactttctgtttaggtgcgctgtccgctttcttaatggcagctttaatatcttctttcgcctgttcgatcgtttcattttcctgctcttcgctccacaggtttttctgttcgaggaacttgcggaaacggacgagcggatcttttttcgcccattcattgtcaaggtcttccgtacgataacgcgtcgggtcgtccccgctcatcgtatgcgggccgaaacggtagcagatcgtttcaatcagagaaggaccttctccggcgagcgcccgttcgcgcgcgcgttttaccgccgcatatacactaaacgggtccatgccgtccactacaatgcccgggatgcctgcagccaccgctttttgcgccagtgttttggccgcagtttgcacggaacgcggcgttgaaatcgcgaactggttgttttgaacaataaaaacagctggggctttaaaagcacccgcaaagttgatgccttcgtaaaagtccccttgtgaactgccgccgtcccctgtatatgtcacggcaacggcctttttgccgcgttttttaatgccgagcgcaacgccggcagtctgcacatactgagcgccgataatgatttgcggcgggagaatgttcaatttttcaatgcccttcatcccgtccacatgtccacgcgaccataaaaatgcctgttcaagcggaaggccatgccagatcagctgcggcacatcgcggtatcccgggagaatgaagtcctctttttcaagtgcaaaatgggaagcaatttgggaagcttcctggccggcagtcggcgcgtaaaacccgaggcggccttggcggttcaaggaaatggaccgctgatcaagaatgcgcgtatacaccattctccgcatcatttcctgaagctgttcatccgttaaatccggcatgagggaatcgtttacaattttcccttcttcatttaagatttggactgtttcaaacttttcttcaatatcatgaagcgtctttacttcatcaaggtttgtgcgtgaagccatcccgttcaccaatcctttctttatccgcatatatggatatacaatttcgccgattttaaaaaatgtgtgtttactgcagaaaccgacaattctttcaagtaaccgcaatcatttttggcctgccaaaaaagcgctgtatcaataaaaaagcggatgtgactaatacaacactatattcaacatatatagagtacatgaaaaataaaaaagcgtcaattataaacgctttttctatccgatatttttttaatataccgaatcattctccccgggaaaactgtatcaatatgcaatttaaactgtactataaaagcggaaacgttgcgagagaaggttttcaggaaaaccggttccgcgggcccgaaacgttgttgcaaacgctgccattttttgcagcaatctttcccggcatgccggaaattgtcatattttggcgtgatggttccgcattttccctacatataataaaggacaagatgagccgcacgcctttacaatatccaaataaatattacaatagaagtagggagttgatccacaatgttaaaaaagctgaggaagaagcttttaaaacagtggaaagatatgctgcgcaaaaagttaatcgcctgaacttttgaatccctcttttccagagggattattcttttctttatgaaaaaaaggccatgaaaaagttgtgatatgtaccatgatttatatataatagaaaaagttacattgaaaacggagcaaggagagattaatcatgatttacaaagtgtattaccaggaaaatcctgaagagattcctgtccgggaaaacacgaagacgttctatattgaagccggatcggaaagggaagtacgccaaaagttgaaagaccgccgaatcaacattgaatacattcagctgcttgagggaaaatatcttgaatacgaaaagcagcaggaaaattttaaattaacggagtaactgtatgaaatttgttaaaaatgaccagacagcggttttcgccctcggcggattaggcgaaatcggaaaaaatacttatggcgtacaatttcaagatgaaatcattttaattgatgcaggcatcaaatttccggaagatgaactgctcggaatcgactatgtcatcccggattatacctacctcgtgaaaaacgcggacaaaattaagggcctgtttattacgcacgggcatgaagaccatatcggcggcattccgtatttgctgcgccagatcaatgtcccgatttacggcgggaagcttgcactcggccttatccggaacaagctggaagagcacggccttctccggcagacaaagctgattgaaattaaagaagacgatgtgattaaattccggaaaacatctgttacgtttttccggacgacgcacagcattccggattcttacggcatcgtcgtcaaaacgccgccgggcaatatcgtgcacaccggcgactttaagtttgactttacaccagtgggtgagccggccaacttaacgaaaatggccgaaatcggaaaagaaggcgtgctttgccttttgtccgacagcacaaacagcgaagtgccgcattttacgatgtctgaacgacgtgtcggggaaagcatacaggatattttccggaaagtggacggacggattatttttgcaacctttgcctccaatatccaccgcctgcaacagatgacggaagcggctgttttggcgggtcggaaaattgccgtgttcgggcgtagtatggaagcggcgattgaaattggccgtgatctcggctatatccgtgccccgaaagatacgtttattgacacacaacaattgaaccgtctgccggccaaccgggttaccattctttgtaccggtacccagggcgaaccgatggcggcactgtccagaattgcaaatggcacgcaccggcagatccagatccaaccgggcgacaccgtcgttttttcttcctccccgattccgggtaatacgacgagcatcaaccggacgattaatttgctgtaccgcgccggcgccgatgtgatcagcgggtctttgaacaatgtgcacacatcaggccatggcggtcaggaagaacagaaattgatgctgcggctgatcaaaccgaaatattttatgccaatccacggtgaataccggatgctcaggatgcatgccaagcttgccaacgactgtggcgtcccggaagaaaactgctttatcatggataacggggaagtgctggcgctcggtcatgacaccgcagaagttgctggcaaaatcccatccggctctgtctatattgacgggagcggcattggcgatatcggcaatattgttttgcgcgaccgccgcatcctttctgaagaagggctcgtcattgtcgttgtggccatcaatatgaacgagtttaaaattgcatccggccctgacattatttcaaggggctttgtgtacatgcgtgaatccggcgatttgatcaacgaagcgcaaacgatcatcacaaagcacttgaataaagtgatggaacggaaaacgacgcaatgggccgaaatcaaaaatgaaattacggatacgctggcgccgtttttatacgaaaaaacgaaacgccggccgatgattatgccgattattatggaagtttaaaaaaggggatcccgtcaggaagcccacttgaaaagtccaaaagaaaacgaaaaacggcgagacaccaccattcatcgtgtctcgccgtttttttgcattgtataaataaatttaaaacacattttttcagtgtcctccccgttagcatagtgcttttttgtatgtctgtttgaaaaaggcgcgccaaaccggtgtacccgatccggccggcgttttgcagaggaaacgtttccaattttatccatccgcttgaaaagaattttttatttttttttgcaaaaagtactgtacaaaacaaatttcagggtatatactgtattataacagaaggataaatgatttgttgttataaaacatgcttttgctgacaccagcccggctgtcgcagcatcattgaatggttttataacaacctaaaaatccaaacacgaaaaaggagatggatgaaaaatgatgatgagcccagttgaattttttaaaacattgcctgcgaaacaatgccctgaatgcggtcagccgattgaagaacaagcagaatcatacatgctggaatgcgaccattgcctttccaaaaaagaagaataacgccgtaataaaaaagaaggggaaatccccttcttttttattgcaacgataaaatataggctatcatcaaatcggcagctgtctcgagcgctcgttcgtccggcgcaaatttggcatggtgcagcccgtatggtgacccgacaccgagccagaacataaagccagggatttctttcaacatatagccgaaatcctcccctgttaaagcctccctgcattcatgcaggtgcaccccgccgtagcttcggacaaaatccataaagcgggcggtctcttccggatgattgaacacctgataataattacagccgtaatcaatttccgcccggcactcaaaaccgaccgaaagcccgtttgtgagcgtttcaatcctgtgcttcactttttccatcgcttcgctcgataacgtgcggatcgtcccttcaaggcgtgcatgttccgcgattgcattttgaaccgtgccgccggtgattttcccgatggtcaccactgcgctgtcgagcgggtcgatattgcgtgagataatagactggagctgggtcaccagatgggccgccgccaccaccatatcctttgtatgctgcggataggccgcatgcccgccctttccttccaggtcaatatacagttcagatgtattggcaaacagcagccctttttttaccgccaccgtaccagccgggtattccggcgcaacatggagtgccatcacaaggtccggctgccattcatcgtgcagcacttcttccagcatcgctttcgccccgccaggcccttcttctgccggctgaaaaataaagatcagatcatccttaacgggccggcttgcaaaatgcgataaaatcccgagtgcaatcgtcatatgaaaatcgtgaccgcacgcatgcatgtttccttcgtgttccgattgaaacgggaaccctgtctcttctttgatcggcaggccgtctatatccgtccggtaaccaatctttttttcggggcaggtcccctttacttttacaagcaccccggttttccatgttttcacttcaagatggccttttggcaaacgcgaaataaaatcaaggatgtaccgctgtgttttatgctccttgtatccgagttcgggaatccggtgcagatcccgcctgatggcaatcaaattcgtttccatatccagtccttcctttccggtatggcaaaaaaggccgggcaccgtttttttggcacccgtccccggcttacaaatttctgaggtctttcatgatttcggttttggattttgttttttcgtcaatttctttgatcacttttgccggaatgcccgcaacaacggtatgtggcggcacatcttgcgtgacgaccgcaccagctgccacaaccgccccttttccgacgcgtacgccttccagaatcacagcattcgccccgattaatacatcatcctcaatgacaaccgggttcgcagaaggcggttcaatgaccccggcaagcacggtgcccgctccgatatggcagtttttcccgactgttgcacggccgcctaaaacggcgttcatgtcgatcatcgtgccttctccaatgacggcgccaatattgattacggcccccatcataatgacggcgttattgccgatttccacacggtcacggatcgtgacgccaggttcaatgcgggcgttgattccttttaaatcgagaagcggaatggccgagttgcggcggtcattttccacaacataatccgcgattttgccacggtttgcttccagcacggccgaaatctcttcccattcaccaaagacgacagccatgccgccgcctgcaaaaacacgggctgattcaccgaaatcaaggccttcgacatttcctttcacatatacttttacaggtgttgattttttgctgtttgctatgaatgaaatgatttcatttgcatccatcatgtccatatgtatgcctcctgacagcagattcgcacgtaaatgtgatcatttgcgcatatgtttcattttaaaggatatggggctgcgccgcaataaattcacgcaccacttttacaaaagcacggacctgcttcaattgaaacgcggcgtcataaccgagcagccatgtgtcgcgtttcagcggctccccgccttccccttcgagcggaattttgtgcagatggcggatttccgccccgtccagcgtgatcgcaggcaaaatcgcatagccaataccgttaaaaaccatttgcttgcacgtttcgatctggtctactacgattgtttgtttcggggaagtttgaaactcgcggtgccaccagtccatcatttcctgataataattcgaatcgcttttaaactggataaacggccggtcggcagccggcagcttttcaagggtgtcaatttcctggtctacaagaaagagcggatcttcaaacaaatggattttcgtacttttccattcattcaagccgcggacaatgccgatatggacttcatcttcgtaaatggaccgcaaaatttcactgctccagcccgtaacaagcgagatttttgcctccggatatttttcaacgaatgttttcagtactttcggcagccagttttggccgacgatcgtggcgcaggcgatttttaatgttccgtacacttttgagtcgagcgtgcggatggcttcccgcacattttcttccctttcgagcatttcgttggcgagctggatgaccagttccccttcaggcgttatgatcaaccctttttgcgtgcggagaaacaattgcgctccccactgcttttcaatcgactgcagcctttgcgacaaggcgggctgcgacacaaacagccgttcagccgccttccgcatatttaactcctgtgctaaaacagacagtaactgacactccgaaaaattcatgttaaccccaatccgttttctttggtttatggaaaaaaggaccgcgcagccatttgcgcggtgccaccgctaaaaatgattcaatttatgaatatgatggttcaattccttcagaagcgaacgccgtgtaaaaatgccggcaaaaaatccttcatcgtcttcaacacataaaaaattgtggtcaacaagccagcgcaacgctttttcaaaattgtcatgcacattcagccgtggaatgtccgccttcatgacctgttccaccttaatctcgcctagtttttcaaactcaatccgttccaaccccaaaatggaatcggtgatcatcgcggaactgatcaggccgtgcagtcggtagctggcgtccaaaaccggaacagcggcatacccacttttcgtcagcacgagcaaagcatgttccaggctgttcccaacctgcacatgggccactttttcagacgggatcataaaatccatgattttcggttcaagaaattcctggctctgcaatgaaatcatcttgcaaaaatctccttttcttccgtattttcaggtacaaaaaccttcaagaggagatgcttatttcgtttgccgttgatgcatgatggatcactactattttatcataaacaggacttgattgacgaaagaaaaacgcccggctttgtgccgggcgaaaaaattttttaactgtcagagccttcctggacgatatcaaagatttcgatggcggcaatatccagatcgtcaaactggtacttgctggcgtgtttttgcccatcgaatacttccagttcaaacgttccggtctgcgggaaaaatttcacctggcagagcgccttgccgttcacttcaaaacgccgttgctggacttcccctgtatcttttgcttcctgcatcgcctgcagtctttggataatacctaataattgagacataatggactcctttcaacgaacgtgagtaccggttttggatgccggcattcacccttttattcacacaaatgataacctgtcccattcgaattttacagtaaaaccttcgcttagaaaagggagcggcggcaaattttttcattttgtgccgtttctgtccttattttatccgaaatcggggaagaccttgtaacatttttgcgatttgtcccggagaaaaaactcctgttttaaaagaagccgctccaaaaaattgaaaagaaaacataaaaacggcgagacaccgctcatccagagtgtctcaccgtttcttgaatactttttcagtgtcctgcttttaaagcagagggcccggcgcgaacaaatcgggcaaaacagctttcggcacagctattctgaccgtcacaagcggatttacaatctgactgatttctagggagcatgtggcactcaacagcctgtaggcgtcattaaacccaagcccgaaagcagcccggaacctgtttgcagccgctcgcatcccttttttcgtcgccgcttccacggtttctgccgatgaaatcaaaaaccatgcgcggtcggtttcaacggccggcatgccgatagcgggcgcgccggccagtttcgtgcattgcagggtgacttttccgccaatctccacgccggaaccgtccagttccccgtcccccattgcggcgtgaagatcgccgagcgcaagcagggcaccatcatggaaaacgggaaggtacaatgtcgaccccgttgtgatccatctcgtatccatattgccgccatggtccccgggtgtttcacaaagcaccgcgcctttttccggggcaacgccgataacgccgatcatcggggcagccggaaattgaagctggctgttaaactggatgtgaccgtctttcacacggatgatgcgcgtatcggtttcttttacatcctcgccgagcacccccatcccagggtaaagcaccatgacaccggcttcatccagctcgatattttgaatgttgatacaaaggatgtcgccttttttaaccccttcaatctcaatcgggcctgtcgccgggttgataaagggaatgtccacttccgtcctaagctgggtttccaatgtgatttttccgccgtagcaatcaaacgtctccacggcaaacgtttcgttcagccggactttgtaagccggcttgttttccgctgaaaaatgggtgataaaatgttcttttttcagttgctgcatgatccgctcctttcgcggccgtttaaaaaggatgctgattcagccactggccgccgtccattgtaatcacttctccattgatataggcagcatgggacgagaacaggaaaaaagcaagttcggcaatttcttccggcgttccgagccgtccgagcgggacactgtctaatgtcctttttgccgcttcttccgattcccacagcttgcccgcaccgcctgttctttcaatcgggccgggcgcgatcgcattgacgcggatgccgtattttttgccccattccaccgcaagcgtacgtgttaaggataacacacccgcttttgccgctgcagaatggacaacgccggctcctgccccccaggcataggtggcgaccatattgaggatgctccctttgatctttttttctatccagtagtttccaaccgtccgtgaacaatagaatgtcccgtttaagacaatattgatgaccgcattccagccgtttaccgataatttttccgccgggcagataaaatttccggcggcattattgacaaggaaatcaatgcgtccgaattttttgtctgtctcttccaccattcgctggacgtcttccggattccggacatccatttgcaccgtgagaatatcagaatggtaacggagcagttccgcttttgttgcctttaatttttcctcatcccttcctgtaatgaccacttttgcttctgactgcgcaaatttattcgccattgccttccccactccgcttgaaccgcctgttacgatgacaactttttctttcatcaaccttctcccctttcatgaatgaacagccattcattatatataaaaaaatcaacggattcggcaagctgccggataccgtcgcaaacgatcccagtgccccggcccaagtgcttccagggcgtatgaaactaagaatctttttttatttttaataaggactcatgcagcttcgttaatgcccggatgatcgttttcttacggttatagccttttaccacaaccgtcaggccgttatattccgcatacgcctgcccccaggcactgtcacgcaaaaaaccgaaaacgtaaactttaatatatccagcctcagccgggataaaaatcatgtccattctttcgctcattttgaacgctccttccgtgtccaaaaatgcggcccggattccggctggcaccgaaaacgatagaaagagccgtcttggtgaaattcttttttctataccataccatacaatgtaccattagtcaggggaaaagaaaatacgtttttgcaatttaaccggacggattttacacaaacagctgcttttccacttcttcggcggggacaggccggctgaagaagtaaccttgtgctttctggcagcgggccgattgcaaaaactccacctgtccttgttcctcgaccccttccgcgacgacttcaagcccgagctggtgggcaaggtgaatgatcgtttttgtaatggccgcatctttttggctgttttccagttcccggacaaaagactggtcaatttttaaaatgtcaaccggaaattttttaagatagttcaaagaagaatacccggttccgaaatcatcgaccgatatcgtcagccccatttctttcaggctgctaagcacttttaaaatatggcctttatcttccattgcgccttctgtaatttcaatttcaagcacggacgcaggcagcttgtatttttcaagcgttcttccgataagtccggccaggccgggatcaagaaactgcttcggggatatattcacagcgacccggaaaccggcccaccctttttgccgccattgtgcaatttgcgcgcatacgtgatcgatcacccacgcgccgattgaagtgatcagccctgtttcttctgcaagcggaatgaatttcaaaggcgggacattaccgaatttcgggttgcgccatctcaacaaggcttcaaaacttttaattttgcccgtatcgagctgcacttgcggctgataatggacggccagctcgtttttttcaatggcgcggcatggcgcggcggagatgggcttccatcaaaatataattatggaagtcggcatccatttttttgctgtaaaaaaggaaatgccctttcccccgttccttcactttaaaaagagccgtgtccgcatgtttgattaacgtttccccgtcttcgccgtcttccggaaacaggctgatgccaacggacggcgtcaaaaaataatcttccccttcaattttaaacgggtcataaaagagcgccaggatctgttccgccatttgcttcacttcttcccgtgagcgcccggccgtaagcacgataaactcatccccgccttggcggtacacttcgtaatccgaaaaggggagctgcttcaggcggatggctatccgttttaaaatttcatcgccgacatgctggccaagaatatcgttaaaaaatttaaaacggtcaagatcgatatataatacagccggatggggcgcgcctttttttgcttccgccgttttcctgttcaaccgatccagcaaagcgtgcctgttccaaaggcctgttaaagggtcaagctgatatgtacgtgcatccggaagcatccgttcgccatccagcagtgctgtcacatcccttgtaatggcaatcacccactctccgccgttcatgccggccaaagaagtatggaggatgcgccttgcatccgaatgatgaatgaagtcgacagctttgttatcttccagcgcagtttggcaaaaatatgcaaaccgggcggcttcctcttccccgaggacatcatgtagaaattttccggtcttttccatctgctcttctttgttcacataaacaaacttaaacgccggcccgttctccactttcaaaacactgaccgtctcggaaagcttggaaagaaaatcgcggctgaaaaaaacatcgattggcagttcctggaatttctttgtttgtccttcagctttcgatttgtccataatatcatcctttttctgatcaagaaaatgcttgctgacgctgaaaaactcaggtgaaagtatatttctattttacagagaaatgtacgaaaagcatagttaaaatacaaaaaaccggggcggaaagtgcggccgggaaatccgcggccgttgctttccttctaggccggccatccatttgccgggtcccgccactcccggtttttgtctttttccgtcggtagtgatccgcccgtcgctcacttgttgccccttttttacttctgatttgcgataaagggccaccaatttgccttcccaagcatttttacaagcaccggcacaaacaagggcagcatgatcaaggcataaaacagaagcccggtaagtgtcagggtggcgatttgcagcaatgataaaacgccggacggcatcatagccgcaaaagtgccggaaagaatgatggctgcagaaagaataacggtccccatctttttcatggcaagcaaaatcgcctcttttgcaggcaaatgctggtattcattgaaccgttccattaaaaagatggaatagtcggtaccgagcgcgattaaaatgacaaaaccgaagaacggcaccgcccagctgatacccggatagccgagcagatggacaaaaatgatttccgttaaaccggcagatgcaaaataagtgataagaagggacgccagcaaatagagcggcatgacgatcgaccgcaagaaaatcaaaagtgcggcggccaccccgatcagcataaaagtaacggtacgcgtgtaatccgctttcgacatcttatccaaatcgcggttgatgcttgacacgccgccgatcccgatgtgggcattttccaattttgtcccctttacggcgtcttttaatgcccggttgatatgactaatatcagccattgccctgttggaatacgggttttcatttaatatcagatgaaaagtcaccatttttccgtctttcgaaatataatggccaagcgctttctgataatccgcatttgaaagcagggcatccggaatataaatgccggactgttccatacttgtttcatccgccaaatcattcagataagaaccggcatcgtacaacccggattcgattttcccgagtcctgctgcgcttttatcaagaccatcggaaagctgattcatatgggttccaaacgtcgtgaggccggttttcagctgtgcctggccgtccgcgatcccctgaagccctttttgcagcgccgggattttccggatcacttcgttttggcctgctgcggtctggttcaaaccgttttcaagctgatcaagcccgttgatgatcggcgtaaacccatcggcaaagcggccaagcccggcggaaatcgctgaaagttttgcgtccacgctttccaatgttgctgtgacggcatcaatctggcggtacaggctgacaatggtatcattgtcattaccggtgccgagcccaagctcattcatcgcctgctgcactttttggaattgcgggtcattcgctgcttccggattatcttttaaaaacgcctggtaagccgcttgcagggagctgacctgcttcggaatatcagccggcaactggtccgtttggctgataaactggcggatgccagactggacgagctggtattttccatacagctggttaaaaccggactgcagttcctttgcctgctgctgggcattttttaccccgcttttcagttcgtccgcgcccgccgaaccgctctggatgccttcttcaatccggctgagcgagtttgacagattccccatgccggctgagattttctctgaaccggcctccagctctccgatcccgtcggttgcttctttaaactttgatttggcgttttccagggaaccggatgcccccgttaatcctgatttgattttctgaatgccgttatggcttttttccagcccctcacccaatgttttggcctggtttttgacataaatttctttcattaccgaaccgtccggccttgtcgcgctttgaatttgtgcaacatgcgggactttatccagatcagcgctgattttctcgattaaagcgagatagtcttttgatttaacaggctcatcattctcgaggacgacttcggccggcattgctttcccggcgccgaaactttcggcaatgatgttgaacgcttttacggaatcgtagttgtccccgagttcatcgagagaattgaaagacagctttccgttatagctgatcaatagcggaaccatgatcaccgccacaatcgcaagggaaagaaacggccttgccagcgcaaaaaggccggcccgttcccaaattttgctttcatggtgggaaatgtccccgcgcacaggccagaacagccctttctttaacacagccataaaaaacggcacaatcgaaaacagggcaaacagcaaaacggctaccccgaccgcaacggcagaagcggattggtacagcttaaaactggcaagcccgatcgaggcaaaaccgatcaggacggcaatgccgctgaacagcaccgttttcccggccgaacggtaagtcgcaagaatggccggcaatgtttctttgccatccgccagttcttccttaaagcggctgagcagcaaaatacaataatccgtaccaatcccgaacaaaacagcaacgagaaaaatttgcgtaaaatttgaaaccggaaaatcaagcttgtcgacgagtatcgcaacgataaactggctgacaagataagaaagcccgaccgttaatagcgggatgagcggcgcgacgattgaacggtacacgagcacaaggacggccaggatgaaaacaatcgtaatcgcttctgtttttttcaagcccgcctgtgatctgtccgtgacatcttcattgatcagcctgttgccggtcatcatcacctcgacgcccggcgtttttaccgctttctgcaaagccgcgcgcactgttttaaaagacttcttgcccggatccacgctggcaatggccatcaccgtttttccgtctttggagacaagctcacttttaagggccggctcgcgaaaatgggttgttaagcccgtaatcgcatattgctttttatttttttccagccgttcaagtgtgctccggatatgccccatctcatggccggatatttttacccggtcatggaacacgatgatgacgcttgtaccgtggttttctgtctgctggtgccggcttttgatttcagccgcccgttgcgaggcataaccttccggaaccttaatctggcctttttccctgactaatggttccattgccggcgctttccatgccaataaaatgctgatcaatgcccatactaaaacaacaatccatttcaactgcaccaatcgcttcatgaactggtttcctcccaagcttgtgatcacgtcactcttgaaccattataaaacaaacggccgcagaagtatgtaaaaaaatggacattttcatgttgctttctttccaaaataaacgaaaagtagtataattgactaaaaaataatatgattaaaaatgaaaggagttctctatttgaattcgcataaacctgctccattacaacctacaatcgaaaacctctcttatgctgtattcacggtcaatcgccatgcgaaaaccgcaaccaatccaaaatttctttaccttttaaagaaaaaagcgcttgaaaaaatgatccgggaagggaaagcactgaaagtcgggctacacttttccgagcatccaaagtacagccagcagcagtctgatgtgcttgtaaagtgcggtgattatacattccatattccgccgtcaaaagacgattttaaaaacctcccccatctcggatacctggaccataaaacaaggaacccgaaatgccgcatgcctttaagccaggctaagcagttgctcgagcagtatactgggctcacggaaaaacaacagcatccggggcagccccgcaccggcagaaaaaattgcaaaccggtttttaaaaaattgggtgactcctttttctaagccgcaataagcgcaaaccaaataacgggaaaatccgtttgcaaaaccgggtaaaagaccccttccagatgaatcacgatacgcaaccatacaggaaagccctccgcgattagccgggggcttttctgcgtttacagcactttttcgtccatcgcaaggataagctggttgatttcaggtttactgatttgggcatcggcgccgaccatttcccctttatgcctcaatgcgtccgtgatcagcgacgaaaagatgataaccggcagcacttttaatgcaggatcttcttttatttttttcgttaaatggtgtccatccatttgcggcatttcaatgtccgtaatcacaagctggacttcatctttaatctcttttccgctttctgcaatcccggataaatattcgaatgcttctttcccgttttcaaaaaacgcaatttgttcatacccggcttcaagcagcgtatcgcggagcaattccctgagcaggccggaatcttccgcgatcacaatccgtttattgttccgctcccgctttccaagctttttgacttcttccacccggatcgtggcttccgggttgatttccgcaatcattttttcaaaatcaagcagcaaaatcatcatgtcttctttcttgatcacgccgatcacctgtgtatcggtgcccgcatacatcccagacggtttttcaatttgatcccaggagaaccggtggatttttgaaacattgtccacatgaaagacaattttttgctggttgaactccgtcacgataaatttgtcatcctcgcccgtttcaggcggataaccgagcactttgcgcaaattaacaaccggcagtatttccccgcgcagctggataatgccttcaacatttggatgggcgtgcggaatggtggtgaccgcagccggcatgataatttcctttactttaatgacattgatgccataatgattttgtgcaacagaaaattctacaatctctacttcgtttgtgccactttccagtaaaatctcgtgctctagactcatctttctcaccccctcgttctaaaacgtatgaaaatccggcgcggagcattttgtagactgcccgattctcaatatttgcccacatgaattatatcggcagatggaccagaatgtttcacctctaaaagggcaaacggaaaagattgctttttcacaaatgtgcaagcgtggtaagatgaagaagaacaggacatacatatttaatgaaaagcaattcgtgaaagaggaggaaaccggttttggaacatttactgaacccgcatgtgcgggagattgaaatatccggcatccgcaagttttcaaacatggttgccggaatcgaagacatggtctcatttacaatcggccagcccgattttaaaacgccggaacatgtcaaacaagcagggatccgcgccattgaagaaaataagacaacgtatacccacaatgccggcgaccttgctttacgcaaggctgcagcacaatttgtaaaaacgaaatacaatctgtcttataaaccggaaacggaagtcattgtcacgatcggcgccagcgaggcgatcgatattacgctcagaaccgtattgacacccggttccgaagtcatcctgcccgggcccgtttacccggggtatgaaccggccatccgcctgttgggagccgttccggtgcacgtggacacaagggcaaaccggtttaagctaaccgcggatctcatccgccaggctatcacagcaaaaacgaaatgcatcattttgccgtacccttccaatccgacaggggttacgctcgaaaaggcggaattgcaggaaattgcagacctgctccgcggccgtgatattttcattctggccgatgaaatttacagcgagctaacgtacaatctgcagcacgtctcgattgcttcgtttttgccggagcagaccatcgtcattaacggcgtctcaaagtcccactcgatgaccggctggcggatcggcttcgtgtttgcgccggaatggctcacaaagcatattttaaaagtccaccaatataatgtgtcgtgcgcgccttctatttcccagatggcggcgcttgaagcgctgacagccggcatcgatgacgcgcacgccatgaaaaaggaatatgaaaagcggagagactatgtatgcaggaggctggatgagatcggcatcgggtatgtgaaaccggacggggctttttacgtattcgcaaaggtgccggaagcgttgaagcggtcctctttcgattttgcgctcgatctggcaaaacagcaaaaagtcgcggttgtcccgggcagcgctttttcgaagtacggcgaaggctggttccggatgtcttacgcatgcagcatggatcaacttgaaaaagggcttgcgcgcatggaaaagtttgttgcaaatctatcctgaaatatgcgccggctgattttcatttttccgccggtaccgcattccatgggcaatgggtgttatgctgaaaatgaaatatattttcattccttgctggcttgctggcgccgcgttcgccataaagagagaagcctgcgttaaaccataacggcttcccgtgttaacaaaatttgctggaacatgggcatatgacccggccaggatgatcccgccagcataaaaaataagcccgccggcatatgccggcgggcaaactttacttggaccaatatttaatcaatgcttgtgtgccgctattttcttcaccttttgcggccagttcttcatataattttttgctgagcgcaagccccggcaggttgagccccattttttccgcttcatcaagggcgattttcatgtctttaataaaatgcttgataaaaaagcccggggaataatcgcccgcaagcatgcgcggaacaagattggacattgaccagctcccggctgccccggcgctgatagatttgagcactttttccggatcgagtcctgcttttttcgcatacacaaccgactctgtcacgccgatcatattggaggcaatggcgatctggttgcacattttggtatgctggccggatcccgggccgccctgcagcacgatattttccccgagtacggaaaaaaccggttttacttcttcaaataccgattcgtcgccgcctaccataatcgtcaaattgcctttttgcgccccgatatcgccaccggaaaccggtgcatcaagcgccttcacctgtttcgctttagccgcttcatcaatctttttggcaagggtcggcgtggaagtggtcatatcgatcaggatcgttccttctttcgccgcgccaagcagcccgttttccccgaaatacacttcttccacatcgtgcggatagccgaccatcgtaatgacgatatctgattttgcagccgtttctgccggcgtgctgcaccattcggctcctgctttgagaagtggctccgctttttcttttgtccggttatagacaaaaagcggatatcctgcattccgcaaattttgcgccatgctccggcccattacgcctagcccgataaatccgatctttttcatcctgggtccccctttttcgcaaataaacaaaaaagcctgcatcacagcaggccaaaagcaaacatgggggtacaaggaagaaaacaatctttcctctattttataccccgcatgatctgctttaaacctggcaaattaaatcgatttgacttttccgccgtcgatcaggaagctgcttccggtaacataggaattggcttccgaagccagaaacgcaacaaacttcccgaattcgtccggttcgccgtatctgccgagcggaatcgactccagttcctttgcctggacttcttccatcgattttccggttttctccgctgtcactttgtcaagatggacgatccggtccgttgcaattctgcccgggccgaccgtattcacaaggatttggtacggggcaaattcttccgccagcgttttcgaaagccccacaatgcccgtccggaacgtattcgacaaaatcagccccgggatcggctccttaatggatgaagaggcaatgttgatgatccggccgccgtttttctttaaaagtggcaatgcttccctgatgatgcgtatgtacgaaagcagattcagttcgaatgatttttgccagtcttcatccgccatatcttcaaaacttccggccggcggtcctcctgcattgttgaccagtatatccagtctgccgaatgtatcccgtgctttttgtaccatggcgcgaatatcttccggatgggtaatatctgcccggatatacgctacttttccggtgccgtaagcggataattcttcttttgccgcctgcagtttttcttcattccggcttgtaatgaggacatccgcgccttccattacaagttgtttggctaccgctttcccaagcccctggctggaagcggcaacaagggcggcttttcctttcaaccctaaatccattcaaaatccctccccgaaatcttatgttcacaaaatcctgtcttcattataaacgatttttccccatccatacacgataaagcttcaaaccggcttccccaccatttttccgttaaaaatggatatccggcattttgatgtgcgctccgccaaagcgcaatccaaaaaaaagccgaatggcaaagccactcggcaaaaatagggggaaaaatgagaaagaaacgatatacatccggtattgtaacaatactggataccaataatactacccttaatgctgggatggtttacatatacccgcttccttcgcccctaaacctgtttttgaaaaattttttttatgcctttgaaagaacttttttcacgtgttcttttacttcttcgttcgttgtgaggttcaaaacgtcttctgccagtttttccatatcagccttattcaggttcctgatttgggaacgggcccttaaaatcgaagaagcgctcattgaaaattcatcaaggccgaggccgagcagaatcggaatagcgatttcgtctccggccatttcgccgcacatgccggcccatttgccttctttgtgcgccgcgtcaatgacgcgtttcacaaggcgtaaaatggccgggttatacggctggtacaaatacgaaatgtgttcgttcatacggtctgcagccatcgtgtactggatcagatcgtttgtgccgacactgaagaaatcaacttcttttgcaaacaaatcagccattacggcagtggaaggaatttcaaccataatgccgacttcgatatgatctgcaacctgcacgccttcctggataagcttttctttttcttccaaaagaatcgcttttgctttgcggaattcatccagattggaaatcatcgggaacataattttcaggttgccgtatgcgctcgcgcggagcaatgcacgcagctgggtgcggaaaatatcctgtctgtccaggcacaagcggatcgcacggaagccgaggaacgggttcatttcttccggaagcggcaagtatggcagttttttgtcgccgccgatatccagcgtacggactacaaccggtttgccttttaagccttcaagcaccgctttataggcttcaaattgcacttcttctgacggaagctcgtccctgcccatatagaggaactctgtacggtacaggccgacgccttccccgccgttccggatcacgccgtcgagatcgttcggggtgccgatattggcaaccagttcaaccgtatggccgtctttcgaaacggatttttcattgaccagcttcgcccattcggctttttgccgttcaaattgttcctgcttttgtttgtattcatcgaccacttcaggtgtcggattcacatggacatcgccattgttgccgtccacgatgacaaggtcgccgttttggatatcctggatcgccgttttcgtcccgacgactgcagggatttccaaagaacgcgccatgatcgcagagtgggacgtacgcccgccgacatttgttgcaaaaccttttacatactggcggttcaactgcgccgtatcagaaggggtcaagtcttcagcaatgacaatgacttcttccgagatcatgcttggattcggaatatccactttcagcagatgagccagaatccgttttgtcacgtcgcggatgtccgctgcacgttcgcgcatatattcgttgtccatttgttcgaacatggtcacgaacatatccgcaacttctttcaatgcgtattccgcattgacctggtcatccctgattttgtcctggaccggcgtcaacagttccggatcttccaaaacgagcaaatgggcatcaaagatcgctgctttgtccgcccccagttccttcattgcatgctccctgatcgcctgcagttcagacttggattcagacacagcagtatcaaagcgtttcaattcatccgaaacattctggacagaccttttttcaaaagacaaatccggttctaccaggcgatatgcttttgcgatggcaatcccgttggatgctgctataccttttaaaatggttgacattattcgcccagaccctcttttttcattaattcagctaaagcgttcaatgcatcttgtgcatcgttgccttctgcagaaatggtaatgtcggcgcctttgccgattccaagggacataacccccatgatcgatttcaggttcactttcttatccttatactgcaattggatatctgaatcgaatttgcttgccgtttgtacgagcaatgtagcaggacgtgcgtggattcctgtatctgctgttactttaaattgtttttcagccatgggtagaacgactccttttctataatatagttctaaaaataatgcactgtacatttttcgtcaatatttatcaaccatcttcatacaaatgacaaattttgcaaacgggggttgaaaaaaaccgcagcgatgccgggtacctgcaaacaccgttcatccccggttattcagcaggctgctccctcaaagtacgcgcggcccatccgtgccaaaaacacgcctcgcccgaaaccgggaacacgcatgtccccggccggatcaaaaaaatgacaaatattgcacagtgcgggaaaaacaaaatccccgtaatagaataacatgcctttccaaataaaacaatcatcagagttgacttcattttgcttaaaaatgcacaaaattatgcatgccccggtcagatttccggctcgtccaaataaatatagcggacattcccgccgcgcaaggcaatgcccttaaaatgtttaaagtcttcctcggcaataagcactttccggaagtccataaaatcttcacggctgacgaataattcttcgatttccctgttgcgaagccggttgatttcctgtctgatttcttcttccgacatacgaccaccccacccggtattgtaccacattcttcctgccgcctacttgtttgctttcgcgattttttaaaaccggcccgatttgtatttttctgttcctttcgccttgaatttttcagaaaaatagtgcaaactggttacaatactttcttacgggaggaccgcaatgaaaaaagcacaaattggtgacattattgaatttaaagacgggcttcaaggaattgtcgaaaaggtgaacgagaactcggtcatcgtggatttaacctatatggaaaactatcaggaactggagcttgatgaaaaaacagtggtcaatcataaaaactatcaggttatccattcggctttacattaattcaaacgcttaccgcgcagtaaaaaaccggcacatgccggttttttactgccgtttctatgattgtgaattttttaacattattttcccggatacctttttccctatttctctgctaaaatattcaatgtatttttgtttgacccaatgccgcgaaggccggactgcggggccggatctctttttggcccttcccggtttttttgccggcggtttgcgaacttaagaaaggagcgcattggcggtggcaaaaaacatggtggatacaaagcttctcggaagtatcttgatcgcccaccttctgctatatattacgtttcgggatacctccgttttttggtatttatattccggagcaatgctgtttttgatcagttacacggtttttcttggaaaatcagaaaaacacgaaaagcttccgtaccttcaattgctgttgtatggcattttttcgggttttctcctctatattattttcagaattggcaatacagtactcggttttttgccgggcgggcttgacaatgaagtcgcccgcgcatacaggcgtttttcgcccgaatccttctggcattacttagcgcttgtcctgattctcatccccggagaagaaattttttggcgttcatttgtccaggcccggctcatgaaaatgatggaagcgaaatatgcgattttgatttccgccgtattgaacgcatccgtttatttttactgcggattaaaaatcatggtcattgccgcttttgccggttcgattttctgggggctgctgtatgcaaaaaaacggagcctgtctgcgcaaattttgtcgcatcttacctttgatttgctgcttgtcgtcttcctgccgattttttaagcagggggacggctttttttcggcatttgcccgccacaaatgcataacaaccgcgcaaagctgttttgaatgccttaccggtcacccccggatcgtctttattccgagtgccatcataaaaacaaggctgaaatagccgaacaagggatataaaaccgataatagcgggccgtaatgcaagctgctgatcagcagaatggcggaaaaaatcaacccgtacagcaaaccgcttttcatcgggatatatttttgcatttgccgctcaagcccgtaggcatccccgataatagaagtgaaaatttccccgaaaatcagcagaacataaataaaataaatgcccggaaaactcgctttcacaatatgcgccatcggaatctccacttgggcaacgtccggcagcgtgaccagtgacaaatggctggaaatcaggatgagcgttaaaaacagcccgcccagtatcccgccggcacggacgacttccttatctttcacttccgccgcaaccgggacaagcaccgcctgcgcgagcgccaaattcaaagccgcataggaaagggcgcggagaagggcacggggcatatcaacactttccggccgggccatgagcgcttgaaaaaatccgggtgactggacggactgcgacaaaaggagaaaattaaacaaaagcatcaaaggcacgacaaacgtgttgacgccaagcagccccttgatgccaaagcacatgacaaaaaaggcgagcagcaccgtcaataaaatccctgtccccctgccaacacggagctgttcctcgaaaacagcacccgcaccggacagcatgacgccacagaccccgaatagcatggccatcatcatcacattcacgaaaccggccgcttttttgccaaataaataccggtttaaggtttcataggaatccgcatgtaaatcgatcgctttttccatcatttttgtgccaaagaaaataaataaaaaccctgaaaggcagatggcaagcaatccatacagcccaaactgtgtaaagaaaacggtaatttctttccctgttgcaaaccctgccccgatcaccgttccaatatatacggctgcgatttggacagcaccgccccacttattcaacgcctgcacccctttaagaaaaaataagacaacctgccggctccgttactatcctatgtcccgctttcttaaaatagccctgccggttcatttccgccgctaaaaaattggtcaaaaaaagtcaaaaaaacctttacaaacaaaaaaagttgtcatatactataggcaaaggtcaaagatagtcaattataagatggtgccattggccgatagcgcaaatgacaaatgcagatcttttgattttcgggccgcgcagttgtatcatgatattagaaaggtcaaaaatagtcaaaaggtgactcgcagatgccgtttccttttttcagcacaagacaaatgactttgccattctactgtaaaggccaaaatgcatcaaaggggtgcatgcaaaagacttgcatcttgtgaaattttgagctatactgatttccaattaaggtcaaagcaaatcaaagcgctttgattgtttttcaatctcattagtcaaagatagtcaaaatcaaaccgatcaaaggaggaatgtttgatgttatgtgacaaatgccatcaaaacgaagcgacgatcgggatgcatataaatgtgaacggaaaccaaaaaacattgaacctgtgccagtcctgctaccaaaaagaacgggcaaaattcgaaaacaactggggaggcatgtttatgaataacggatttggaaacttcggattcggaggattcaacgacctctttaaccaaatgaacgccaacgggttccagccgaacggcgcgaaacaaaccgtacaaacgcaaacacagggcggcggcaacggactacttgaccagttcggccgcaacctgaccgctgctgcacgggccgggcaaattgaccctgtcatcggccgtgatgaagaaatcgcccgcgtcattgaaatcttaaaccggcgcaataaaaacaacccggtgttaatcggcgaaccgggcgtcggaaaaaccgccattgcagaagggctcgctttaaaaattgccgaaaaacaggttccggcaaaactgcggcataaagaagtttacttgctcgatgtggcttcgcttgtcgcaaacacgggaatccgcggccaatttgaagaacggatgaaaaaattgattgccgaactggaacaacggaaaaacgtgcttctgtttattgacgaaattcacctgcttgtcggcgcaggttctgcagaaggttcgatggacgcaggcaatattttgaaaccggcgcttgcccgcggcgaaatccaggttatcggcgcgaccactttgaaagaataccggcaaattgaaaaagatgccgcacttgaacggcgtttccaaccggtacaggtcaatgaaccaagcctcgaagaaaccgtcatgattttgcgcggcttaaaagaccggtatgaaaactaccaccacgtttcctataccgatgaagcgattgaagcttgtgcgaagttgtcgcaccgctacatccaggaccgcttcctgccggataaggcgatcgacctgatggatgaagccggttcgaaattgaacctgacgattgcggttccgagcaaagaagatatccaaaaacggcttgctgaaattgcgcaggaaaaacaaactgcggttgcaacggaaaactatgaaaaggcagccgaactgaaaaaagaagaacaaaaactgaacgagctggctgcttccggacaaaccgaagccaaaccggttgtcgatgtcacgcaaattcaggaaatcgtcgaaaagaaaacgggtattccggtcggcaaactcgaagcggatgaagcgaaaaaactgcagcatctggaagaaaacctcgctaaaaaagtgatcggccaggatgaagcggtccggaaagtggcgaaagcaatccgccgttcgcgtgccggcctgaaagcgaaaagccgcccgatcggttcgttcctgttcgtcggcccgaccggcgtcggaaaaacggaactgacaaaacggctcgcggaagaactgttcggcacgaaagatgcgatgatccggcttgacatgagcgaatatatggaaaaacacagcgtctcgaaactgatcggggcacctgccggctatgtcggttatgaagatgccggccaactgacggaaaaagtgcgccgcaacccgtacagcattattttgctcgacgaaattgaaaaagcgcacccggatgttttgaacatgtttctgcaaattctcgatgacgggcgcttaaccgatgcccaagggcggacggtcagcttcaaagataccgtcatcattatgacgagcaacgccggcacccaatttaagcataaaacagtcgggttcgctaaaagtgaagcgatcaaagaatcgaatattctcgattcactcggcgacttcttcaaaccggagtttctgaaccgtttcgacaacattatcgaatttaaaccacttgaaaaagaacatttggttaaaattgttgacctgatgctcggcgaactgaatgaaacgctgaacgaacaagcgattacgcttgacgtgacagcagaagcgaaagaaaaaatcgccgaactcggttatgacccggcatttggggcccgcccgatccgccgcgttatccaggaaaaaattgaagaccggattgccgactttatcctcgaccatccggaaagcaaaaacttaaaagcggaagtccgcgaaggtgacattgccatcgcggaaaaataaagcaaaaaccggcatgcggacatagcccatgccggtttttgcattccggcagatggacagcacgggccatctgccgggttttttatgtttgtaaaaagatcgaacgcagtccaaacccggctgttgtaaatcaatcggaagaaagccgggttttattacccggccaaaaccagtccaaacaaaaaggcgggcgggaaacatattcatccggaatattgatcagggattcatccgcactcaaaggagcaaaaccaagatgcaaaggttggaagcagttcccctgtttgttaaacaagctgcatggctttatacgtttttctcgcttcagccagattgagccgctgcactttttcatacaatatgaatgacatttcccggataatcaccatttcggatgaccgggcgttgtgctgctttcgataggcttcatactcattcatgagcgaatccagctgctggctgcaccggaccgttttctcatgcgtcaggcccagttttttcccaagctccatcatttcctgacgttttttctgaattctgtaaagatacttgttctcctctaacatgtgcgtgtccacttccaaattctcctttagttctctttttctattgaatgattgttatcccccgattatgcttcaaaaaatgtgaggtgttacacatggaaaatggcggactattctgccggttttccgcatgatggcatcgtggcaaaagttctctgcaagccggaaaggcgcaaaagccctgcccccatcctgcttattttaccattactaaagtagtatcgcaggtcttgacggaaatgtaaatacaatcgcaatattagacaaaattttcgccaaaaattttcacatctcccgaaaaaaccacccgtttttcaccgctccatgttttttttggtcacgcagtggaaaaataaaagagaaaaagacatgaaagaagtgaagcagatggcaaaaaattttctgctggccaaagcagccggatggttatttcgttcaaaagcaaaacagtatttaaacgaccggaaaaaaaccggcgatctggttaaccgcgcggagaaaaaagcactctccaacaaaatcacgcttgccaatatgtggagtaaaatccgcgtccttttccagcttgtcagggcatgggcaaaaggcgaataccgcaccgttccgtaccggacgattctcatgattgtaatcggccttatttatttcgtatctcccattgacatcatccctgattttcttgccggcgcgggccttgttgacgacaccgccgtgcttgcttttctcctgacgcaagtgaccccggatttggaaaaatttttacaatggaaaaacaaaagagataaaagttgaaccttggtccgcgcgggatttcaaaactttgccccttttagataatcgccccttcaagatggagcaggaatgccttttgatcgatccggctcccggcatagcctgttaacgacttgtcttttccgatcacgcggtggcaggggatcaggatcggaacagggtttttccggttcgcctgcccgacggcccgcacggctttcgggttcccgacagcctcagcgatgtctttatacgagcacgtttccccatacggaatttttttcagcgcttcccaaaccgccatttgaaagggagtgccggagacagaaaccggcacatcaaaacgggttcttttctttgcaaaatacgcttccagttcactggctgcgcgcaaaagcagcgggtggcggggttccggcataccctcttcatctgttttgccgaaagaaacggccgtaatgcctttttcatcagcccttactgttaaaggtccgattgggctttccagccaaataaaagccattttcatcacctgcttcctgctgcacgggaagaaagatatgaaaagttgtgccttcccgtactttgctttggacttgaatgaagcctttatgctcctttatgattttataactgatcatcaaaccaagtccggttcctctttcttttgtcgtatagaacggctcgcccagcttttcaattttatcgtccgggatgccttccccttcatgttcataacgaggtggggtatacgtttcggagtaatcttcggtgtaaatcacaagcgcaaatatctttttatcatacgcatcaaaaatccggtagaagtattgaaacattctttctgcaaaaccagtatctttccacccctgcacttcgatatggacaagtatccactgttcgctaccatctttcaaatacactttaaaaagcccgtctgcttcccggtcacggcttttgccgtccggattcagcttttggaactccttatccaggtcgtcaggtagcttgtcccaatcaatcatctcatacaagcctggtgaaaaaaacgcaacaaaatcttcaaacagcgaatgaataacccgcttccaatgacggtcatattcattgcgcccagtccgcttatccatcccattcccccttttcaagtattaaaactattccgtttttattatacaacatttttgaaatgaagggaacaccaattcgacaaaaatgttgatttcaaaatttttcgtcttttgatccgaaacgtagatgggtgtgaaaacgccgactatatttcagatgtctccgctgatgtccgtgaaagtagaccaataccctgcaaacgccacagattctataaatcaaccgttcttgatatccgctacaaacctgccgccgaccagcccctcctgataaccggttttttccttatcgcatttcatctgcaagcgccagcaactcgagcccacaataacgtccccatcgatcacaacgcgactattatgaattgaaaaaacagattttccacctttccacatatgaagatatacctgagcggacttgctgaaaaatcacttttttgcttcatcttcttcccgactttttggcaggccgcgtttttttccatgagggctaaaatctctcctaaagcagcggcatatcatagcttggccggaacagtttgtagatggaaaccaatcttttccaaaatgggatttacgtttcaaacatataatagatgtgcaggcgtcctatacgagagtgcgtttcaagcatacgatacaaggggaaaattctctgtcaaaaaacggacacttttttacaagccggttttgttgaagtttcggtgataagttttataataatatttagttcaacgaaatatttactccgtatacttttgttttcattgcgcaaggaggcgattttctcatctaatgagccaggaaaaacgcaatttgtatattatgtttgtctgtaactttttagtgggtgcaagcttaacgatgatcgttccatttttatcgctatatattcaaacattcggccatttcagcgataactatgtccagcgctgggccggatatatttttggcgtgacctttttggttgctttttttatgtcgccaatctggggacgtatcggcgacaaatacggctttaaaccgacgcttattattaccgggttcggtatcgccgcgagtctgttttttatggggcttgcaaacaatgtcgccactttatttacgacccggattttcatggggatcgtgaccgggtttatcccgacttctatggcgctcatttcaaagcagacctctaaggaagaagccggcaaggtgctcggcactttgcaaatgggaaatgtttccggaaacttatttgggccgctgattggcgggtcgattgcagacaattttggttttaaatacacttttatgattacagccgttgccatttcgattgccgcacttggcgttgttttcggcattaaagaaaaacgttccgatccggcccggcgaaaagagaaacccgtttctccccttgctgttataaaacaaattgtcagccgccggattttgattaccgtcatggtgattgcgcttttgatccaaatggcgaacttctgcgtccagccgctattggcgctgtatgtcagccatttgacaagttccggcaatattgcgttcctatccgggcttgctttttccgccaccgggttcggcaacctgcttttgacaaggcagtggggcatgctcggcgacaaatacgggcatgcaaggattctcttgattttgcttgtgcttgcctgtgccttcatggtgccgcaagcactcgtaagccatttatggcaactgattattttacggttcctgtttggcatggtgatcggcggaatgaacccgagcattgtggcgtttattcgtctcgaagcgccgctcagcatgcaaggtgaagtgctcggttataaccaaagtttccggtttctcgggaatgtaacagggccgctgattggcggttacgtatccgtgatctccggcatttcatctgtgttttatgtaaccggggttttgttcctgttcgcatttgcgctccttctttacagtgtaaaatcagaacagcgccgcaccgtccgggaaagctaaaacggcaagatacccttttgatggtatcttgccgtttttttatttttccttgccaggtcgcgaaacttttagcttttttttggcacgaccgcaatggtacagcgcgacaggcaaattaagttttcgtcttcgtctttgattttgatttcccaaacctgggtgcttttgccccggtgcacggcctcggcaactgcggttacggtgccgtttcgttttgagcggatatggttggcattgatttcaagtccgaaacagacttctttttctaaatcgatcagcatcgcagccccgaggcttgctgcggtttccgcgagtgcaacggatgccccgccgtgcaggtatccgagcggctgtatcgttttttcattcacaggcatggtcgccactactttcccgggctccatttggacaagttttatgcccagcgcgccgatcattgtatgttccaattccatctctttccccccggttcggattgtccatacatctttcaagcctttctttcatacgatgtaaaaaatgatgatccccgcctgagaaagaaggtgagaatattgtactacaatccgtattatgttgttccttcctttccatactattccatgccttaccgccaatatcctgccgtccacccgaaaaaatttatggattcggccatgcgcacgcacgcgctcttggcagatgcacagcttttgcttaaccgcatttcccgctctacggcttttgccgggcaactgatgtctgctgcacaaaaatcagattcgaccgatgtcggtcgcatgctgacgggtaccggtatccagcatataccgcgcgtgttttatacaccggacggccttgtattgcagtttgtccaccaggccgcgggcaaccaggaaccttgctgtgagctccggatgaaaatgcgctggtcataacttgcggcttgtccatagctctgggatcctgccccccgaattgttttttataagctgtatgaaggacgaaaccaaagacgcggctctctgatttgtccttcatcggctgtatgaaagacaaaatcaatggctccgtgctccgaattgtccttcatcaatccgatgaaagacaaatttcaaatcccagaacggcgaaatgtccttcatagactgaatgaaggacaaaatcaatggatccgtacccagaattgtccttcataagctgtatgaaagacaaaatcaatggctccataccacgatttgtcctgcatcaacccgatgaaagacaaatttcagatcccaggacggcgaaatgtctttcataaactgaatgaaggacaaaatcaaggactccttaccccaaattgtccttcataagctgtatgaaagacaaaaacaaaggctccgtgctccgaattgtccttcatcaacccgatgaaggacaaatttcaaaacccagaacggcgaaatgtctttcataaactgaatgaaggataaaatcaaggactccttaccccaaattgtccttcatcgtttgtatgaaagacaaaaacgtgggcgccgctccccaaattgtccttcatgttttatcatttgaagccgttccaacaaaatccttgtttcggaacttcttgcaaccaaaggagccgggtatctttccgaaaaaataacccccgcttgagaagcgagggttatttttaataatacgggaatggcggatatcccccgtacggaaccggtggatatggcaccggagggtatggaaaatacgggcgcggccttaccagtgcgccgccaagcaaaccgccgagaaaaccacccagaagcggtcctgcgaaaaacggggaacgtgccgggtaatgcgcatgcggatacatcaaatgacctcctctccttctatttttagtgtatgcatcccggcactaccggattgggcgttacgcagacgctgacttttgctggctcttttttttgcgcctctctttccacaaaatcagaagaagcgttatcatcggaaaaaccacttgcatagggaggtgaagcagaacaggcaccactttgatgccctcatcaatatgttccgcatacgttgacgcaatcatcaccgatgcgcacaacatgatcaggccgagcggataaactgttctcttatagctgctcacatgaaacagctccgtaaacattatgcaagccgcatataagaaaatccctactttaaaaaagccgccaacgattaaagccaacataaaaaatacatccaaccgctccagaaaatgggcgatttgaatttcctggatggtcgtaagcagcggaaacggggaacgcatcattacatccacgccaagtacacaggtattgatcagcatcgagatcgccaaatttgtaccgcttaaccacatggcggacagcccggctacctttacaccctttatcttgtctacaagcggaaaaatggacaaaaacgcaatcgtttcgccgaaaggaatataaatcgtctctgtcgccattgttttcataataggcatgggtccgttttccagtatgggtttcaaataattaacgttaatgagccccaatgaagtaatcaatacgaaactcgtaattgccaaaaaataaataaagatgaaaaagatctccccggttctggccatcacttccattccttttttcactgcatacatgacgcaaaaagccatgatcactgtgataataaatcgcggtgtttccggataagccgatataatcagcatttctccaaagtcgcgcagcaccctggcagaaagatacaaaaagtaaatgcccatggcaaagccgaaaaaccagccaatgacttttccgtaaatcgcccgcaaccattcgaccggcgaaatgccaggatagaaggaaaatattttgtaataaacgtaaaacaagaaaaacccaacgctcaagccgcttaaaaccgcaagccatgcatcctgctttgcgtcctttccgatccccagcaaaagggcactgcctagttcaaacatacaaattaacacaaataattggtatgaggaaatcttcgccttttccatatatcaccaggccctattattttaaatttgaaaggaatggatttgtccgtagttcagaattggcgatgacgacatctgcatgtactttcacttttaaatgggcaaaaccattttcattccaatgatgctttaaactgtgccactctttcgggtactggcggtaaatcatttccccgaagccgaacacatcacattgctcgcgctgcatatgtcggatgcctttgttgatttgctgctccacatttttttcgtatgctttttcaatccggaccatttccttggaatccattacatcaagcggcacatcgacttcttgtagctgacctgcaaggcgaatgtgaatatgcatttccggcttcccgtttttcataaccggtttcattccgataatcgtttttcttacccgcagcccgagcgcatttggatgatgagcccagtctatttctagcgaagacatctttgtttttttcaatagccatgtaatcgtacgggcatcctgtccgcctacccaatcaatcaattttccatgttttaagatcccgatccctccgctcgttaagtatgcgtccagttttgtttgattctggctgtcctgcttccctccttttttcggatcccctatcagcttgaagcttcccactaccgcttcttttccttccgttgtaaagtcatataagatatcggaaacatctgtttttattcgcccaccgacattttcttccgcatcttccaatgttttattgattttattggtcggaatacggtcaatcggcgtcagcacctgaaggatatcttccgccttacctttgcgggcaatcagaacggaagcagtattgcggaattctttatgcctgtcaaaagtatcaataaccggatagatgccattttccgccaagtttctgccaatcaagagaacgtttgtatgagaaaaatatagtctcctggaaatttcctggtctgaagcgagaatggcttcctcaatcgttttgccttccgtctgatagatggtaacaggaggaccctgcccgccgccgatttgcatgccgcttggaatgtttaagtaattaacaatttgataggtcagcaaataatgcccgttctcaagctggtcaatgccaatggtgcttacaaaggcaatatccgttaactctttatggctccagcagcctgtcagcaaaaaagaagccataaaaagggcaacggccgttttccatcgactgctcatcatggttgctccccattcgcagcatttttttgtttcggcggcattggcttttgattttctgcctggcggacgatatttttctggctgaagagacgcggcctggctctcatcgaccacattggcacgcggatcaccgtatcaccggagttggaacgaatgaaaggggcaatcggcgccgtgtatggcacgccgaaagaccgcaagctggtcaaatggacaacaagcgcaatcatcccaataatgatgccgtaaaaaccgaaagtagccgccagaagcataaaaacaaaacgatacaatctggctgaaacagcaatgaaataagaaggggtagaaaaactggcgatggccgtgatagataccacaatgaccattgcgggagaaacaagcccggcctgcactgccgcttgcccgatgacaagcgccccgacaatcgagacggtctggccgatcggacgcggcagacgaagtccggcttcccggaggatttcaaatacaatctccatcccaattgcctcgacaacagccgggaaaggaatcgtctcccgctgcgccgcgagcgtgaaaacaagctgtgttgggataagttcctgatgataggttgtcacggcgacatagacagcaggcccaacaagtgagattaagtagctgagcacccgcaaaaagcggagcgctgtcgcaatgtcaaaccgtgtataatagtcatctgccgactggaaaaattggataaaaacagcaggtgcgagcaaaacgaacggcgtgccgtccacaatgatggcgaaacggccttccaataaattggccgccaccacatccggcctttccgaatggtacattgtcgggaaaatggtatacgttctatcttcaatgagctgttcaatatatcccgattccagaatggcatcgattttaatcgtgtttaaccgtttacgggcttcttcaaggattttatcgtttacaattccttttatgtacatgagcgcaacatcggtctgagtcacttccccgattttaaagttctcaatccacaaattcgggtctttaatccgtttgcggatcaatgaggtgttcacacgtaaagattcagtaaagccttcacgcgggccgcgtacagttacttcggttaaaggctcttcaatcgcccgctgtttcccgccccttgtgctgatgcttattccgccgtatacgccgtcaatcagtaaaatggtctctccgctcaacagctccgcaaacaagtcattccaattcatgaccttttttacgccgccaattttaatgacatgctttatgatgctgtcgagtatattttcaccgtccaaatacccgtcgatttccggattacccatcaagatttcaagcaggttttcattgatcattttcggatcatccaggccatcaacggatataacggcagccggtaaatcattgccacttccaagcatgatttcatgaatcacaatatcagaactgttcccggttgtttttttcaactgttggatgcgcgtttttaaatcggtgcccatggtcaaacacgggatatccgttacagtcccgctcgtatcattcccgcgcacaggtgttttctgcacatccccgcttttctttgcacttttgtttttattttttgcagcgcttctctgttttttccaccaatatggcataccgatcctccttttcgcccgtgcatgactgtttgcaacggagcacaaactactgatgaagatatcttgttgttagtatgtttcgattcgaaaaaaatatgaaaggaattagcatgcatgaaaatcgctttcctgaccgggattgtcgcactggtcctctatgtcttcatcgctggcattgatttttatatgacgagggaccttattagctctatctaccatccgatcggtaccttcgatactttttatcctattgaaaaaggcgtgctgatgttatgcatcatggcgctcatatttaaaatcacaatcggtgtgttgaaacagaaagaacggctgcaaaaatgaagaatcgagtaggaggctaatcatgattcattagcctcctactcgattttaatcctgttctgccatcttctcagccagcacggccagtgtccgtaccattacaccggttgcgccggccgggccaagatcggtttctttccctgttaaggcggttcctgacatttccagatggacccacggggtgtcttccgcaaacgccccgataaaagccccgttttcgatcacgcggccttcgctgcccggccaaccgttcaaatcggcaattttgctgcttcgtacgttctctatgtccgcttccgttacagggaagcgccagatgaattcgcctgcttcctttgcagattccagtactcgttcaaaaaaagtatcgcaattggcaacagcgcccgttttatcacggccgagcgccgagaccacgtccattgtcaaggtggcaacatccacaatttgacttgcaccatattgtttcgcatacgttacggcatctgcaagcatcagcaacccactggcaccgttatcccgcacttcaatcgttttgccattcatgctcgtgatgacagtgcccgtttcaacaggcattttaccctgtccatcgtttgcaggaacgccccctgtggtaccgtttatgcgattaccggttacgggaagtaccgccaccacgttttttgccggtttccgttccccgaccacttccatggcacccagaatagctgctgcccctgccatgcctacatttgcaccgggtgtgcaaccatcgatcacggcgccggttccgacaagtgcaagcacattgccccattctcgttcgcccgcatatctcagcacgatcatgttcggcggctcttttgattccccggccgcagccaaaatcgcccccattccaagcttttccatctccgtttttttaaggatttccacttcaaaagcgtatttttcagcaagtgatgcggcgtattccgcgagacggaccggtgtccaaatattcaccggcgtattgacaagcgttcgtgccgtattcacgcctttgccaaaaacgtacccacggtgcagggcagtgcccactgtttccccggggagatcggtattacggtatgtacccgtttgaagactggcgtttttaaccggccggccttttgcttttccggcggcaccagcatgtccaatgttctccggtcggatctctgcttccccagcgacattaacatgctctgcgtttcccggccggccttttgctttcctgggggcattaacatgcttggcatttcccagccggccttctgtttttctggcagcactcgcttgttcggcgttcctcaacctgccttctgctttcccggcagcaccccaatgaggattggcgttttgaatcggttgtgcacctgcttttccgttgacacgaacgtgttcggcgttttccagtcgggcctcggcttttccgttggtactaacatgttcgacgttttccggtctcccggggccactaacatgatctgcgttttccagttgggtttcagccttcccggcaaccctggaatgaacatttgtgacgttttccaccggttccggttttttcccggcagcccggatgtaaaccgctactttttcgagctgcacttccggaatattcggctgtcttttgtaaccggcaaactggtatgcggccatgggagcggcttcaccgagcaactgcgcggcttcctccccgttgattgtgccggcgcaaaacgtatcgagaaaaaccgctgccgtagcccatctcattttcaggatgtgtttcactgcttttccaaacatccttttcaaatgttcttttctgatttttttcgggttgccaagcccgataaacaaaagccgttttacaggcagttttccgagggtatgaatgacagaaaggctgccggcgtgcgcggatagatcgccggattttaccagttccgtcagttccccgtcgaaacggttgtcgagtttttccagcaagccgtcaaacttttttggaacttgctgcaagccgattacaaggcagtcttcccggcattcaaacggatcccctgtacaaatttcaaacatacaaccacctctgttccattatagccgtccgcttgaaaaaaacgcacaaaaaaaagcgcaaccggcattttgcgctattcttccgtttccggtctaatatattgctgccggaacacttgcatcgttttgttttcgttcagttcagccagttccttttcagtcagggacccgtcccccattttaataatatacacatcaagcgtctgttttccccatttcttgtaaacatccgaaaccgtttcaaaatacagatcgagccggttcccttttatggcggatcctgtatcggccacaacaccgaaatcgtagcctgggatataaaggaccgtcccgattggaaaaatggatgtatcggcagcaatcgttgaatataaatcccgtttcactttcaccccggaataggtgatgccgtagccgggatggtcgggacttttcccggtcgattcggcccctgccgtataccccgttgctgtcactttctttttcgggtaattgctccagtcataggcatcaagggatggctgcggctggctcgcggcaatggcggccaatcctttttccaatgcccgggcaggtgccgcttttgcagctgctgcttttatccccgaaatggcctggaaagtggaaatcattgcccatatgaacaaaatggccatcaataagcggatcatccattttttcatgttcaattggtttcactcctcttagggctattgtttcccatgccgttacaaaatatgcgggcatattggcaaaaaaacgactgatccgcctgccattttttcgcgacaacttattccgcccactctctgttctgaaaatggctcttccaaaaagcgctggttgatgtgcattttttaaacgctttatccgggaatatttgtgccggcttttgccggtccgcctccaatttgaaggcaaaaaaaagctgccctcaaggcagttttaaaacatccggtatccgtttttccggagcgcttttatcgcaacaccagccaaaagtgcccccgcaaggccgctcgataacacgagggcatcagataaatggatggagctaagatgctccccaagttgccggaaagccgtcccgggatcggtaaaataccgggaaaaagcgatccggtcaatcatcgaaagcgcaatgaccgggtaaataaaacagagaatccaggtcatccgcaaaagcatattggcaataaaaccgataccgaaaaacaaaacaagaaaaaggaccatcgaaataatcaataccggtatactcataagcccctccgcatccccgttgtacatccagtttactgaaaaaaccgaatttcgtcaaaagtaacgcgataatatttttgctatataaaattaaattttcctttctttaaaacaagcctcgtgccgccgatcataaacagggcacggtcatccacgacttttttcataacagaagcagaagtgcctttcagctttttgccaaacacaatgccgatcgcattgtcttccccaagggagcagacggtgcctttgtcattaaaagtgaaagcttccaggctttcttcaccgtggatctttttcaggaggttccgtgcgcatacttccccatgctgcatcgccatctgcgctgtcggcgggtacgggcggtttgtgtccttattgatgatcagcgcacagtccccaattacaaaaacattttcatgccccggaacggtcaaatccggtttgactttcacccggccgcgcaccgtttcaaacccggacgcatcaatcacgctattcccgcgcacacccgcggaccagatgacggtgccagacttgatttcgtacggctctccgccttttttgcaggcccataccccgtcttttgttgcttttttaaccgccgtaccaatatggaactcgacacctttgctttccaaatacgaaagggcataatcgacaagttcgcggtcaaattgcgggaggacgacaggattggattcaatcgaaacgatccgcactttatcccgctggatcccgtattctttgcaaagcgccggaatccggttcaccagttcgccaagaaactcgatgccggtaaaacccgcaccgccgactacaatggtgagacggttgtcatctttatcgagttcccttcgataggcatcgaactggcgctcaatatgttcccgtattttttgggcagcgcttacatctgtaatcgaaaaagtatgctctttcaagccttcgattccgaatgtttccgcgttggatccaagtgcaatgacgagataatcatatggtaacacttccccgccttttaactcaactgtgttcgcgtctttttttatccgcttgacttccgcctgcttaaattgcactttattcttatttaagacgttttgaatcgggtagtggacccggtcatggtgcaatgtgccggcggaagcttcatgaagccatgttgtttcgtaatggtaatcatttttgttcacaagtgtgatgtccgcttccccttttacaagctgtttttgcagccgcgtcacggtcatgagcccgccgtagccggcacctagtatcaccactttcggtttctccatttttctcacttccatctctttattttggacaggccggtgcctgtatgacaacatcatccattatttgtgattttattcacgataattgacacgtcaaatttgtcacatgatttccatcaaattgtcacaaaaaatacatattctccacttcaatcatatgctttttacccgctattttcaattgaaaactgtactaaaataataataaaaatattctaatatatcacatcgcaccacgaaatttttccggacgcatgaatacctacctccttgcctcatagagtttttttgcctgtgcgcctgtcccaaaatgtgctatgatgaaggagaatgaagcgtattggaggggtttcgttgaaggaagatcaaaccgtttatgatataaccgttatcgggggcgggccgaccggcttgtttacagcattttacgccggattacggaaaatgtccgtaaaaatcattgaaagcctgccacagcttggcgggcagctggctgcgctttaccctgaaaagtatatatacgatgtcgccggttttccgaaagtgaaggcggctgatcttgtaaatcaattagaagagcaggcctccatgttccagccggtgatctgcacgggccagtccgcagaaaagcttgaaaagaatgaagacggcatttttacgctaacaactgataaagaaatccaccattccaaagcggtcatcatcactgccggtgttggtgcattccagccgcgccgcctcgaagttgaaaatgctgcacaatacgaaggaaagaatctgttttattttgtgaatgatatggaccagtttgccggcaaaagtgttgccatccttggcggcggcgattccgcggttgactgggcgcttatgctggaaccggttgccgaaaaagtgacgctcatccaccgccgggacaaatttcgtgcccatgaacgtacggtggaacaattgaagcaatcgcgcgttgagattaaaacaccgtttgtcgcgagcgaagtgatgggtgatggggaaaatatctcccggcttatgattgaagaagtaaaaggcgatgcgaaagaagcgcttgatattgatgcccttatctgcaattatggctttatttcgtcactcggctcgattaaaaactggggccttgagattcaaaaaaattccattgtcgtcaactccaaaatggaaacaaatatcccaggcgtttacgcagccggcgatgtttgcacgtttgaaggtaaagtgaagttaatcgtaacggggttcggggaagccaccacagcggtcagcaacgcgaaaacgtatcttgacccgaaagcccgcgtccagccgatgcacagcacttcgctgtttgaataaggaaaaatcaaaatcccggatggctgcccaaccgggatttttgattaaatattgctcttatcgccgctccggacccatttcaggacgggggcatttttttgtttcagttcttttttgttctcccatgcactgctttctgatccatccgctttggcgtctgccgcatcatccacgagccatttttttgaattcttgtcatatttaagcgtatatttgcggagggtcttgtaggaatagtcctcataatttttttctcccgtatatttgatcttttcgttataggaaacgagtgcttcaatttccgctttccagtctgcatcaaaatggttgatgctcagttcatccatatttacgacggaacccaaatactgggaagtcacttctttacataatctttaatggcttcaaactgcgcctgttcaagtgaaaagtcttccttaaaagaatcggtcgcgtttgaaagcttattggcatccagtccggaagtcgtatatacgcttagatcctcgttgaacttgcggatcgcctccaaaatccctttttgtacgttttcgcttttttgggcaaggcggctgtcatcaacaatcatgctgacttcggaatttccccataaatcctttttctctttttggaaaaaggttcccaaactgttttttaccgttacattcgtttggtaagttccgggcaaaagtgggccgtaagtatgactttcttttttttccggaactttcatatttccgattgacacattaagctggtcgttgtcgctttgcccggtcacttttaagtggacggtcttcactttcagcttatagtcggggaaaaatccccatttctttccgtcttgaacgaggctgatctgctggttcgtttccgcgtaattttcgtcctttatttggttatgaatgccatctcttatcacctgataactgtttgcattggtttttaaataccggatcatggcctgaagggaagtattgttcaccaatgcattcggattgtcggcaacaatcagcccttccagctgcttcgtatcctttgttttgaccgcattctcgaacttttccagtacccggtcaggttttgaagcctgggagagcgcgatccatataaccgcaagtacaacaatcacggctgcagctatggcaatcagccatttatgtttcgtgagttgcgccataggttaatacacctctccgcctgcaaaagcttcttccagctcatttgtatagtcattctcctgccaaaccgtccattttccgtcttttttcaccatggaaacttctgccgggtcttcagcttcttttggttccatggaactgacaatggaatcgaatttggagagggcatatttttttgctttttctgaatcgtaattttcgctgttatccaaatattcatctgcatatttttccactttttcagaaatatcgtccatagaaatggtggaataggtcaactttacgaccgctttatttttgtagctcgcaacggcttccgcatccagtttcgctttttcggcagcggccgatttgtaggcttcataatactttttcatatctgcatctgatatatcatcggtaatattgtcgttaaaggcttttttaaaggttttatacgcatctgtctggacagcttccttattctctgaaacatatttttcataatcggcattgtccttgtttaaataaatggtgtctatatatgcctttaacgcttttgcctggtcctgcagggaatcgtacgatttactgtattttttggtatccagcgcaagtttcaactcgtcactgtcatccccgcttttttccgtaaacggctggatgcccaatgtatatgttttgcctttttttacttttaccagtacggtcatctttttttgtattgcccgccccgatactgccgccgcgtgaagtgcccatatcgagccgggtgctgtatatgtcgtcttctatgttcacttcttcgttgccatcgtataatttaatattgctatatggagagatatggaccgtatccgaagacacatttttgatctttaagtcaacggccaggaggtctttctcaccgtcttccgaaacatccgcatcgtcatccttcaacagggcataggacgcgtctgtaattgaagcttcaattaacttgtttttattggaagatcccccttccgcttctgcttttttatctgatttcccgcaagcagccaatccccataccaatgccagaacaacaagcagcacatgccattttttcactgcagtttcccctttccaatcttcattctgcagctgataaatcgcagaatttccttaactttttatcgaacccggggtacggtttttttatgtataatgcgggtaaaggaatacataacgcagcttccccctcgacattcctttctcccccattatgcaaggaccaagttcccttcccctttttccgaaaaatccgggcaaatgagcagctaaggtatatctacccttttttccatgaataaacatatttacgaaaaagtattttatttttaatgactttgtaaaaagttgtggctttttagcgcaaggaaggcgtttataaatgcggatgtacaaacagcgaaggaaattggcgtgcccggacaggaagaaaaccggaagacaggcgctggctggattttttgaaaagatttttgtgaggcttgcgaatgaaagggactttgccaaaaaggagcttaaatcaattcagcagcgcaaaagccccgcctgtcattggcgggatatcctgcgctgctgcaatgaaatgggaaccttgctggcgtataaatatcctgtttttgcagcatcactttaaatgcttcagcatttttccggtgtgccggcttttgttttagttttaaatgaggagccgcatccgcaggtgacaatcgcattcggattatcgatcgtgaacccgccccctaaaagcgactgcttataatcgatgaccgtgccggttaaaatcggggcgctctcatgatcgacgagaatccggatgccgtgctgttcgccgaccgcatcgccttctttgatttcgtggtcaagcgacaggccgtacgacaggccgctgcagcccccgccgtttacagacacacgaaaatatgcgtcctgctcatcgttttgctccatcatgtctttaatttgaaacgcagctgcttctgtaagatgaatcacttcactcattttccgaacctcctttccttgattataaccatttacaccgtgcaaaacaatgattgcgtatctcccgggcgccgggcagtcttaaaatgcgggctgctttattttaaaattgcattgcaactcgaaaaattcaacaaagtcgctgctgtaaacgttttttaatgaaaaatttttaatcgtgcgctgcaaacgcattttccgggatatagccgtattgctccatgaccgcataaattttctttagccttggattgccttctgccaccggctcgccttcaatgacaacaaccgggtaaaacagatcttcatccatcactttttgcgcaaaagcacgcactttttgatcatcaccgggtgcaaaaatatcgatatactggatgtcaaacggctggcccgggtatttccgcgaaagtgctgctttgagccattcaaatgtatctttagaagacggcgcaccgacgcagcttgcgcatatttgctccgccccgtaaacttgaatcgtcacttttttctccatcaaacccgcacctcttccggggatttcttattcatattgtacacaacagcttgcaaaaaggaaaacactatatcccgtttttttatgatagatttttcttgtaatcctgtttataatgagaagtaagaaaggagcgatcatatgcctgcagatacaattacagaacaagttcaggaagtattggataaattgcgcccgtttttgctccgtgatggcggcgattgcgagctgatcgacgtggaagacggcattgttaaactccgccttttaggggcatgcggcagctgcccgagttccacgatcacgttgaaagccgggatagaacgcgcattgtttgaagaggttcccggcgttatggaagtagaacaggttttttaacgggcagtacgcggtttcctatcaaggaaccgcttttttactggaataaattttacttggacgggatgattctctggttattcacgcatccgtgcttgccttcactacggtccggcccggcattcgaaacctggcccgagatgtgtttcaagtgcttgctgtccttttctacaaggagccacatttttattgaatatctgcatggtgaatggttttctgaaatgctcaccatgcctgacatccacacttgccttcactacgggccgggcttcattcggaaacctgaccggagatgcgttttaaactagccggccttttctacaaggagccgcttttttatcgggctttgagccatgccaccctgggaatattgtattttcttatcggaacttccgagagctcataaaattcagccagaaatgcttcgtatgcttctgccccccgtacaattttccaaagctgttcctcatgcattttttgttctttttcggaccgggtgagaaaataggtttctacacattcaaaatagtgaaggggaaacagcaggcgcgcgaaaatgagccgccacgaaaaaggcgaaagcggcgaaagcgaaacatattgctgcaaaaacgcgcggacatcagggcggaacgtgtgtgttttcttaaaatactgcgcgcggatccactcggcaatatccctgcctgcgtggtcaaacacccagtcaaacgggtggtggatgataaatttccggccccacgtttcgtttgaaaaccgttcatggcaaatggtgccggcatctcccgggccaggcgcctcatccatttccgtatcgacgacatactggatcgcattttcacaaagccccatgtaatagggaaacgtttcggcaaacaggcgttcaaacgggtggtcggggtgctcttctactgttcggtaccatgccttttccatttgttcaaggcgcatttcccagtaatttttccattcgcccatccggtttgtttccgttatcgtggcggaaagcgtgcggccgcgcaggtggaatttcgcaagtttcctgcccgtgcgcatatttccgggcgcttttttataacggttttccagtaaaacataatcgctatccccgtctgttacgagaaatttcttttctttagatggataaaaggcggaagcatagcggtcgccattcgtcacgaggtgccgggacatttcatataattcaacaagcacattttctgaaacatttgtcacgggaacgagcgtataaagattaccgtttgcttcatagcggacctgttttccgtcaaaaaaagactgcccggcgtcaatgccgtaatattttttcaaaatggcttgtgccatcatcttccctccccaaaaaatgcattgcactttctacattatatgtgaaggaacgtgtattcttgcttgatctcataaaatccattagaatgatcatgctaaagaaaatgtcgaataattgaggtgagaacatggaaaacaagaaaaatatggatgtgtcagaacaaattgcaaggcagcggctgaaagaacggggcgtagaattggaagatattgcgaaactcgtcctgtatttgcaagagaaatactttccggaaatgacgcttgaggattgcatggaaagtgtcaacgccgttctttccaaacgagaagtgcaaaacgccattttaaccgggatccagctggatgtgctggcggaaaaagggatgcttgatgaaccgctgcaaagcacgattgcggtcgatgaatccctttatggtattgatgaaattatggctttgtcgattgtaaacgtgtacggttcgatcggttttaccaactacggttatattgacaaacaaaaaccgggcattttggcaaagctcaacgaccattccgacggctcatgcaacacgtttctcgatgatattgtcggggccattgccgctgcagccgcaagccgccacgcacacagagtggcgcacgtgcagccgtaaaaacacgaaaaaaaggcaagatacgtttttgtatcttgccttttttcgatattcgttttccaaacaaatcggactttacaacaggcgggcatatggagccttcctgatttgcacccgcgcttgtcacacttcccactggtcaagggaatcaaccgtataggtcggcaggatttcttttgtcttcaacatttccttcgtcgttatgccggtatggacgagcagggtgtcaatgcccgtgcggatgcccgccagaatatcggtatcgtaattgtccccaaccatgatcgtctcttcttttttcgaaccgaggtattcaagcgcctgctcggtaatgatcggttccggtttgccgataaagaccggcttggtttgggtcgcaaccgcaagcaccgaggttaaagccccgtttcctggtagcagaccgcgttcagtcggaagcgcaatatcggcgttagtggaaataaatttggccccgttccggatcgcaatggcgccgagggcgagcttttcgtaagtaatctcccggtcaatgccgagcacgacataatcggggtgatcggatgtgatcgtaaaacctttttctttgatggccgttttgatgccttcttcgccaatcacatatacagaagcatccggcttttcatcataaataaaccgggcggtcgccatggatgtcgtaaagacctgctccgtttttgccgggatatcgaatccgcgcagtttttcggcaacctgtgccggtgttctcgaagaattgtttgtaacaaataaatacggaatccctttttcctgcaaccggctgacaaaatcgccggcttcttctattttttccgttccgcgatacatggtaccgtccaaatcaatcaaataggctttatactttttcatgctgaaattcctctctgtttcgttgcttattcccctttaaaagcgttgaccgggccgagttcgtttgccaggtaagtgcgcacatcttccggaaaccgttcaagcgccttgaaattagccgcaagcacttcctgaagggtgccgtaatccagatccatatacccccggacaagctgcttcctgagcgcgatgacagccgtcagctgctttgccgattcagcggaaaccacattttcatcttccaaaatgtcaatgatgtcttcgtagctccccggatcgcgcataataaacccgtcaatgatcgcgtttccgacatccagaaccgattcgatgacggtttctgcaattctttccaaagcagccttttcgatttccgtctgccaggccggctgcgcttgaaacgaggcaagccgtttttccataaatgacaatatcccgtttattttttcacgatcgacaaaatacatcctgtcaccttctgcctaaagtttatcaaatggcggtgccgggcaaaacttatttggcaacgattttctttgcgacaaaataggcacagccgaaattgcagtattcataaagatattccgtgagtgtactgattctggtgtcaaaagtggatttcggatttcggtcatcaaaaaaaccgcgcagccgcagctgtccgtaaccccagtcgccgacaatatagtcgtacttttccagtatttcactatatctgcttcggaatgcttcttcattgtagccattccggtaattggcaataatctcgtacgtatggcggtggatggtgaccaatttcaattcctccattttccccgtgtgccttcctgccttattttattataacgaaaaaccgcccaaattctaagcggaacgcgaaaaattttttcagccccattgaacggaaaaactgcgcccattaaagtgcgcagcccgtttctcaaattttttgcgtctgttccacgttccctaaaatatgctttgcttttgcagcggcactgacctgttcatccgcatggtatgaagagcggacaagcggaccggattcgcagtggctgaatcctttttcaagtgcaattctttttaattcggcaaattcatctggatggtaatatttgaccactttcatatgttttttcgtcggctgtaaatattgcccgaacgtcacgatgtccacatcgttggcgcgcaggtcatccatcgcttccgccaattcttccatcgtttcgccgaggccgaccataatgcttgatttagtcggaatctccggctgcatttcctttgcccgccgcaaaaattcaagcgacctgtcgtacgtggcgcgggcgcggacccttcttgtcagcctccggacggtttcaatattgtggtttaaaatatccggttttgcatccatcaatgtttttaaactttcgtaccggccctgcaaatcggaaggcagcacttcaatggtggtaaacgggttcatgcggcggatcgctcggatcgtttcagccatcaccgctgcaccgccgtctttcaaatcatcacgggccaccatcgtcacaaccacatgctttaagttcatttttttcaccgattcagcaacccgttccggttcctgccagtcgagttcggacggcagcccggtttttacggcgcaaaaacggcaggcgcgtgtgcacgtatcgcccagaatcatgaaagtcgcagtccgccttgttccccagcattcatggatattcgggcatctcgcttcttcgcaaaccgtatgtaagttttccgtacgcattaatttcttcagtccggtataattttcattcgtattgagcttgattttcagccattcgggtttccgcaaaatctcttcctgtttgttcattttccatctctcccaccgggttcgttctctctcactttaccacattcgtcccttttttgaaaagaaaacgccaccggtttttccaatatttaatattgatgaaaatccgcttctctttccacaataagcgtaagaggattttcatattgcggtttttctgtttcgacaacattgatagaaagagggttttcgcattgcggtttgttttgcttttctgccttgtaacagggctttcattttctgcccttcatgcccaagcaaaagaaatatccgataaagaaatgtacaaaaaacggatggaactttatcagcatatggaggcatttacccagattccgtggtacaatttggcagccatcgaccagtatgaacggagcatccggtttgtccgttccgacctaccgaaaccagccggccttatttccatttattttccccctgaaaaatggtccgggcttgccaatccgaaccacaatgatacccatccgctttcgattgcgtttttcggcgggatcggaaaggacgggaacggggatgggaaagctgaccgcaacgatgatcttgacgtgctttttacactgagcgagtatttgttgcggtatggaacggatgatgatgactttgaaattgcgctgtggcattattacaaacgggataaagccgtacagctgatcacggaaaaggcgaagatttacaagacattcggcaccattcagctgacagacaaggcgttcccgatcccgcccggatacaattacagctaccggagcacatggggcgaccggcgcggctggggtggccgccgtatccacgaagggacggatatttttgccgattatggcgtcccggtacgcgcgacttgttacggggtgattgaattgaaagggtggaacaagtacggcggctggcgcattggcattcgtgatttaaacaattcgtatcattattttgcccatttaagcggttatgcaaaaaatttacatgtcggccaagtcgtcaaaccgggcatgttgatcggcagcgttggcagcaccggttacggcccgcccggcacatccggaaaatttccgccgcatttgcattatggcatatacaaagacaacggccgaagcgaatggtcttttgatccttacccgtccttaaagagatgggaattacttgagaaacagcggaaataaggaacgctggagcgagcgcagcgctttttatttcgtgttttttggcagttcgatgagcggctgcgctccgccaccgtttccattataaaattgcgggacatcgccattatagttacccattgcaagcgggacatcatgtgtataggtgatgacatccgatgcaaacgggataatgacctgcattttgattttgatttcaacataaatataaaaaaatgcgttgttaatgccatattcttcttttttcactttaatattggagctttcaacatcccccaccatttgaaaggtcacgggaatatccggacccatgtttccgagcagagcaatatcggtcactttcccaagcggaacggaaaaaatttcaggttctgattttttctttttcccgagcatgccgtcgtttgatatttcttcaagagacgtaatgtctccttcttccacttctttaaactggcgggtaatctggttttcaatttcagactgggtggcggccaattcccgcgggtcaatcgtatccaacttgctgttttttccgccgctcacatggtctttgatcgcttcgttcgtgacatatgaggcgatttttttcatttctgactcggcgtaccgcattaaagtaggttttatgccttcatcaataataacaatgctgataatggtggtaaccgtaaaaaatgcgatggaaagcaaaagcacgtaccgcgtcggcaagggtccccgccgttttgaggtgcggaattttcgcataaaaaatcccccctgcaagcaaatgtatgtctgcataagggggattatgatcatattaaaaagcgtgggtccggattgttgtgctgaaggacattttatgctttcaggcacagtggtttgtctttcatgatctggatgaaggacatttcgctggttctcggctcatgttttgtctttcatcgccctgatgaaggacatttcgccactcctcgcactccgttttgtccttcatcacacgggaaggacgaatgcaacatcatctttagtgtttcaacctaatcgaacgtttaaatcatttttaacaatgcttgtttcccgatcatgccggcggtaaccccgatcttttccgcttcatgggtgaccgactcgagcggtgcttccagcaattgttcgatcgtcttcacaccgactgccctgccggcgataatatggcggtcctttagttgatcattcaacaagcccacatcgagcgcgccgcacataatatagcctttgtcgcacgatacggccagcaaggttgttttcggcagccggacagttgtcgcgataaacgtatgccctccgatctcaacaggtgttacggttaccatttccatccgcccctttctttcatattttatgaaaagagcggtgaaaagtgcctgccagccaatgtgctgccatattacatcccaaattcgatctttggaaactccattgaccgtcgctgcttctaagaagccaggaaactgccattgattcattgctacattgctttgcacatgggcatttcatcctactgaccatattcctgcaataacttccattccatcacatcacgcaaaaattccggcataaaataatggattttcgcctcccggatatgcgggaaaaagtcgccaaatgtatacatatcaatcgtaccaagcctgtagatacgatccggttccagcggcctgccccccacctctattttccgcaaagcatgattgaaaccgatattccggtaaataaaccggcccatgattttcccgcggaagccgagccccttcagctccagatgcggccatttcgggtcgagcgttgaaagaagtacttcctgaagtttttcgcccgtcagctcgatcagacacgggttaatcggatgcgggagaatccggtggagatcaaatttcgtgaccggcccgtgttccagactgtcaagcacaaggccggcattcaaaaatgcgcaatcggcatcgcaccattccatgaccgcatcacaaagcaggcccgtaagccggttttccttgaaccagtccgattccagtttttccggtaaatacacgagtttttgattcaataatttttttccttcaaaataataatgttcaatctcggccgcttctccgggcggttcctggaagttcccggtcggtaaagcacgggctgactgatagacgatttttttggcagccggatcgatttcaagcttgacatgcccgatataatagccgtatttgccggctgccgcaagaagcgtccgcccgtccagttcaccttttgccaacacatggtgcgtatgcccgcccaacacaaggtccacttccgggtacagctttgcaataaggcggtcttcatgaatgccgagatgcgataagacgatgaggatatccgcctctttttttaaaatattcatttgtttccctagttcttccagtggattagaaagctgccaacccagcagccggtacagtttataaaatcctgctgtcacaccggttaccccgattttgacaccgctttttgtcgtgtacagtttccgcggcactgcccactgcggccgtttcccgttttcatcgaacaggttggcaagaatcacgtcaaattgtgcttcctcatacaatgtgtctagcgcctcgtgcggcatcgtaatcccttcattatttccaatggtcgcagccaagtaccccagttgatttaaaagccggacatttgccttgcccatggtcccttctgtatacggatgccatctgtcgacatggtcgccgaggtcaaacagcagcatctcttcattttgccgggcatgctgcgcctgtttccgctcaagaaaatgccggattttcggccagttttcaaaatggctgtggatatcatttgtatggtatatatgtaaaatttcgttcatatttggtccccttatcatcatgagggtaatctcgtcatgcggtttcatacggccgctttttatcctttatgcttatgcagtttattttaccacgattttcaaattggcgccccatgaaaaaacagccgtgcggaatccgcaagcggctgttttttctgccatcaccgtctaaaactaggctttacagcaatatatgaggggtgatttgtgggtaaatcgcacccctacgttcaaaaactctctataaccgttgatatatcaaggttatccaatcgaaccttccatttcaaacttgatcaaacggttcatttcgacggcgtattccattgggagttcttttgtgaacggttcgatgaagcccataacgatcatttccgttgcttcctgttcggaaatgccgcggctcatcaagtaaaagagctgttcttccgacacttttgatacttttgcttcgtgctccaaagaaatattgttgtttaaaatttcgttgtaaggcacggtatctgatgtggacaggtgatccataatcagcgtgtcgcattcgacattggaacgcgcgccgtccgctttccggccgaaatgcaccatgccgcggtacgtgacttttccgccgtgttttgaaatcgatttggatacgatcgtggacgacgtattcggcgcaagatggtacattttcgcgccggcatcctggtgctggccttttccggcgatcgcgatcgacagcgtcataccgcgcgccccttcgcctttcagcagcacggaaggatacttcatcgtcagttttgaaccgatgttgccgtcaatccattccattgtcgcattctcttcacatacggcgcgtttcgttacaagattataaacgttgttcgcccagttttggatcgtcgtataacggcaatacgcatttttcttaacgatgatttcaacgactgcgctgtggagcgagtttgtcgagtaaaccggcgccgtgcaaccttcgacatagtggacggaggcaccttcgtcaacgatgataagggtccgttcaaactgccccatattttccgaattgatccggaaataagcttgcagcggggtatccacttttacacccggcggaacgtaaatgaaagatcctcccgaccagacagccgagtttaaagccgcaaatttattgtccgtcggcggaatgacggttgcccagtatttgcggaaaatatcttcattttcttttaaagcggagtccgtgtctttgaacacaatcccgagtttttcgaaatcctgcttcatgttatgataaacgacttccgattcatactgtgcggaaacgccggccaggtatttttgttccgcttccggaatgccaagtttatcaaatgtatttttgatttcctgtggtacttcatcccacgaacggccggcatgttccgtcggtttgacgtaatacgtaatgtcgtcgaaatttaacgcggagagatcgccgccccattgcggcatcggtttattgtaaaagtgttcaagagacttcagacgaaaatcaagcatccattgcggttcttctttcatttttgaaatttcttccacaatttctttcgtcaatccgcgttttgcacggaaaatggaaacgtctttatcatgaaagccgtacttgtaatcaccgatttccggcatttttttagccatcagccatcattcctccaatcctttttcgcttcttacccctttttccattgctttccatgccaaagttgcacatttgatccgggcagggaatttggatacgccgtgtaacgcttcaatatcgccaagatcttcagcctcttcatagtcttttccctgcaccatttccgagaaaatgtgggaaagtttcagcgcttcgtctactgtttttccctttacggcctgcgtcatcatggaggccgatgccatcgagatggaacaaccttcaccagtaaatttcgcatcttggatgaggccgccctccactttcaatgtcaaatgaatccggtcgccgcaagttgggttattcatatcgactgtcaggcttccatcttccaaactgcccctattccgcggatttttataatggtccataatcacactgcggtaaagcgcatcaagattagaagacatttgtaaaatactcctttgctttcacgataccggcaacaagtttgtcaatatcttctttcgtattgtataaataaaagcttgcacgtgcggtcgctgtcacgtccagccatttcatcaacggctgtgcgcaatggtggcccgcgcggatcgcaatgccttccgcatcgaggatggtcgcggcatcatgcggatgcacgttttctaaattaaacgtcacaaggccggcgcgttcgtctgcgctttccgggccgtacaccgtaatcccttctatttcagaaaactgactgaggcaataggcacttaaatcctgttcatgcgccgtaatttcatcaagcccgatttcttcgagaaaatcgatggcttccccgagcccgattgcaccggcaatcaccggagtgccgccttcaaacttccacggaagttctttccaggtggaatcgtacaggccgacaaaatcaatcatttcgccgccgtattcaagcggttccatctcttcaagcagcgcctttttgccgtacaggacgccgatgccggtcggaccgcacattttgtgaccggagaaagcaagaaagtcgcagtcaagatcccttacgtccacttgcatatgcggcgcaccttgggcggcatcgacgaccatgtaagcaccatggctgtgtgcgattttcgctatgtcttttaccgggttaatggtgccaagcacgtttgagacaagcgctgcagccacgattttcgtccgctccgtaaccgttttttccacatcttcaagtcgcagcgtaccgtttttttgcatcggcacatatttcaaaacggcgccttttcttttggcgagctgctgccacgggatgaggttgctgtgatgctccatgtaggtaatgacgatctcatcgccttcctgcacttgtgcatcgccgaaactgtgggcaacaaggttcagcccggctgtcgtcccttttgtaaaaatgatttcttccgttgattcggcaccgataaatttgcggactttttcgcgcgcgccttcgtaatggtcagtcgcttttgtcccaagcgtatggacgccgcggtgaacgttcgaattatattcacggtagtattggttgacggcttcaatgacacggagcggcttttgtgaagtcgcagcactgtctaaataaacaagcgggtggccgtttacttcctggtccaatatgggaaactgccggcgaacttcattgatatccattatctgactttcctttcaatgacttccgtcaattgtttttttacactttcgatcgggagctgtgtgacaaccggtgcaagaaagccgtggatgatcagcctttccgcttcatttttcgaaatcccgcggctcatcaaatagtaaagctgaaccggatcgacacggccgacagatgcggcgtgaccggccatcacatcatcttcatcaatgagcaacatcgggtttgcatcgccgcgcgctttttcgcttagcatgagcacgcgcgattcctgctcagcgtccgatttgctcgcgccgtgctcgattttgccgatcccgttaaaaatcatcgtcgacgcgtctttgacaacgccgtgttttaaaataaagctttctgtatttttcccgaagtgggtaatgcgcgtcgtaaagttttgcgtctgcttgccgcggctgaccacaaccgttttggaatgggaaacggatccgtcgcccacaaggttggtcgtattatctgaaatcgtattgccgtcgttcatcatgccgagcgcccattcaatttgggcatcgcgcccggtgtaaccgcggcggttcacatatgtggtgaccccttttgcaagcgtatcaaccgcgccgtattcgatctttgcattggcgccggcaatgacttccgttatgatgttcacaatgcctttcgcgccatcgtttgccgaaatatagttctccacataggtgacggcactgttttcttcggcaaccaccagcacatggttgaaaagcggtgccgtttcatggtcgtgcacataaatggcctgaaccggttcttcaagcacaacattttttggcacatataagaatgtcccgccgttcatgagtgcagcatgtagtgccgtcaaacggtgttcatcgactttaaccgcctctgtcatgaaaaatttttggacaagctccggatgtactttgaccgctgtcaatatatcggtcaaaatgacgccttgtgcttttgcgctttccgacaaggacagataagccggtgtctggttatgctggatatacaaattttgcttcgcgttttcgagatccacgagcgccttcactttttccggcaattcgttcaaagcgctgtaggttgtgctttccacgctaaaatcggtaaattgtgtaaagttccacttgttcagttttgtcttgtccacttccggaagcggcaggacctgggcccgggcgaatgcctggaggcggaactccttcagccattccggttcaccgttttgttcggaaaaggtgcggacatcttgctcgttcattgctaatttcgtttctgtcatcaagtctctcgccccctgcttaagcttcctggccgaccgtttcgtcttcgatgccaagttcctgtttaatccattcgtagccttccgcttcaaggcggtttgccagttcagggccgcccgatttgacgatgcgcccttgcatcatgatgtggacagcatccggtgtaatatagtctaacaaacgttgatagtgagtaatgatgatgcatccgaaatcttcgctgcgcatcgagttgatgccttttgcgacaactttcaatgcatcgatgtcaaggccggagtcgatttcatcgagaatcgcaattttcggttcaatcatcataagctgcaaaatctcgttccgttttttctcgccgccggaaaagccttcattcaaatagcgttgcgccatatttgtatccatttcaagaaattccatctttttgtcgagctcgcggataaatttcatcagcgggatttcattgccttcgccgcggcgcgcattgaccgccgagcgcaaaaattccgcatttgtcacgccgctgatttcgcttggatattgcatcgcgagaaacaggccggctttcgcacgttcatcgacttccatttccagcacattttttccgtcaagcgtgatggtcccttgggtaacgatgtatttcgggtgccccataatcgctgaagacagcgtcgatttccctgttccgttcgggcccatgatcgcatgaaattcaccgctgtttacttccagattgaccccttttaaaatttcttttccctctacttcgacgtgaagatcttttattacgagttttgatcctgccataaaaaattcctccgttgttaatattcagatccaatttattctcaatttattctcattattattttataacaaatgaaaactatgcgcaactagtaaaaacctgtggataaccatggcatgccatcttttttccgcggttttccggtcttgcttattcattaataatagcacaaaatagagccggtataaaattcctgatacagatttcttgaatttccctggattgcgcattgggaatccaggcagccgcctgaaacggcataaaaaaagccgggatttgttttgcaatcccggttatgctgtgattctcattttcagtctgttatttgataatcaggcggatctggctttgctttttggcacaggttgcggagctcccgcaagccagaataaagattccagcaataaaaaatggcgatacgttcccctgtaccggagttcgcccattttcagaaatgtcccgaggcgcgcacggcgggacagaagctgttcgaattgccggagcgccatttccagttcaaaatccgctttgccggtttcaagctgcacgcaacactccttggaaaaagcaacgagcaagcattcttcccctgtgcggaacgatacggtaacaggcaccgccggcagcagcatccgcaattgttttttccgtgccaggctgttcaggaaaaactggatggtccgtttcatggcaacacgctccaatcctcatttcctttacctattctgcacgggtagcgctgatcctgccggaatcgttcaacaaatcgcgcgcttttccggccggttttggcggcaatgctcgaacagtgtctgaaaaaagttttttctgcggtttgaacggcgtttttgcgcaaaagcctgcccgtttttttccgccatgcaagcggtgtttccgtttatgaatgcccaaatcggatgttccgccgttttctcattaaaaagaagacaatttttcaaataatgccgggacggattgaaaagcgtacactttgtctattgctttcccgttttcaaggaggagcaggcacggcacgctttcgatcttgtatttttccgccatttgtggcacgtaattcagattggctttggcataaggaaagcgggtgacggcctgttctgcaatctccagcatcctccccgccagctggcatgtgccacataatggcgtgtaaaagtacagggcgagtttttcttcctgcaaaatccgttcctccagttgtttttcccttgtccagtcctgcatggcaatccatcctttacacaaaaaggcaccgcagcttggagtgcagtgccagttattttatgcttcgttgatcatttcctcgtactgttccgccgtcagcaaatcatccagttcagcagagtcggccggttcaacgacaatcatccacgctttttcatacggggattcgttgacgaattccgggttatcgctcaagtcggcattaaccgcaacgactttgccgctgaccggcgcgtacagttccgacaccgtcttcacggattcgacactgccaaacggttctttcgccgaaacttcatcgccttcttctggcagttcaacaaatacgatatcgccgagttcggcctgggcaaaatcagtgatgccgatccggacatggccgtcttcttctttcacccactcatgatcatccgtataccgcagttcttcaggtaccgccatctcaatccctccgttatgtatccgtaatagccttcagttttaaattaccgaaaaacagcgcttaaatcaatcactttttcagcaatttttcatacgcatcctctttaaatccgaacacggcaaaggcatcgcctgcaagaatcggccgtttgatcagcatgccgtcggaagccagcagttcaagcgcttcttcttcgctcatttccgggatcttgtctttcaaaccgagttcgcggtacttctgcccgctcgtgttgaacagccttttgatcggcagcccgcttttttcataaaagtccttaagaagtgcttttgaagggggattttcgacaatgtgcaccgcttcataggcaacgtcatgttcgtccaaccattttttcgctttccggcaagtcccgcatttcggataccaatagaaagtaagggccatttttgtccactcctgtcatcttgtcttatctgtatgttagctgatttttcccggcgatgcaaaagaaaagggactccggccgggccggaaatcccttcttttattacagcacatagcgttctgcatcgatcaatttatccgcggcttcgcgttttttcgcaatgacattggttggcgtatggcgcgtcagcttgcggagggcggaaagcgtcatttgcagctggtcgccttcaaggcaggctgcgagcgattcttttgcaatttgttcgcattgattgaacgcttcctgtgtgaaaatttgggtatacagcagtttttggttctgtttttcggcaccatctttgttgattgctttttccgtccgaagcacgcacgattctgccgcatatatattcgaaacgagatctgccacgttggcaagcagttcctgttcgttttcgaattttttgccgtacgtttgcaacgcagtgcctgcgacgagcagggcgatcttcttcatgttgcggacgaggtatttttcctgttcaagcggcgcgtcgccgacttgttccggcatcatcatcatgagttcttcctgcaggctttgcgctttttgtaacagcggcagttccccgctgaacgcttttttcacgtatgtgcccggtacgatcaggcggttgatttcgtttgttccttcaaaaatgcggttaatccgggaatcgcgataggcacgcgagacttcgtattcgtccataaagccgtaaccaccgtggatttgcaccgcttcatcaacaacataatcgagcacttcagaagcgaagaatttgttcagcgagcattcaatcgcatattcggcgatcgcattggccactgcccgcccgtctttttcttcttccggtgtaaagtggctcattctttcatcgaacaatccgactgtccggtagacggagctttcggctgcatacagtttcgatgccatcgtgccgaatttttcttttgtcaggttaaactgcgagatcggtgttttgaactgctggcggccgttcgcatattttaaggcgatttcaagcacgtgtttgctggagccgaccgcgccgacgcctaatttataacgaccgatgtttaaaatgttaaacgcgattttatgccctttgccgatttccccaagcacgttttcaaccggaaccggtacgtcttccaggataagcgttcttgtggaagaagatttgatccccattttcttttcttccgctcccgttgaaacgcccgggaatgtgcgttccacgataaaggccgtgaacttgtcgccgtcaacctgcgcatacacggtgaaaacatcagcaaatccggcgttcgtgatccactgtttttctccgtttaaaatataatgcgtgccggcttcgtttaatcttgcaaccgttttggcgctccgtgcgtccgagcccgagcttggttccgttaaggcataagccgcaagccattcgccggttgcgagtttcggcaaatattttttcttttgttcctcgttgccgaacaaaacgatcggaagcgaaccgatgccgacgtgcgcgccgtgggaaatggcaaaaccgccgacttttgcgagcttttcggaaatcagggcggagcttactttatcaagggcgagaccgccgtattcttccgggacatcggcgctcaaaagcccgagttcgcctgcttttttcaacaatttgacagagcggtcaaattcatggttttccagatattcaatttgcgggaccacttcattgttcgtatagtcttccgccgttttggcgatcattttttgttcttctgtcagctcttccagcgtaaacacttggtccggtgtgatgtcctcaattaaaaaactgccgccttttacaaatgcatccgttttgtttgccatttacaattcctctcctttttatctataatgatcggccgcagatgtgctccgcggctcttatttccattaataacgattcaacaggcggatccggctccggcgttttgcctttagaaacagctgatccgctttttaccatggtccggtgttttgccgttcggaaccggctgctctgcttttggccccggcatctatccatttcatgatccggtatctgacgttgctatttgaaaccggctagccgcctggttcggctcactgcaatcaggacacgagctcaaacacacctgctgcacccatgccgccgccgatacacatcgtgacgacgccgaactgcacgtttctgcgcttcatttcatgggcaagcgtcaaagtcagcttggcgcctgtgcagccgagcggatggccgagggcaattgcgccgccgttaacattgacgatgtcttcattaaggccgagctggcggataacctggatggactgggaagcaaaagcttcattcagttcgaacaacccgatatcctcaaggctcaaccctgccagtttcaaagctttcggcacggcttccaccgggccgatccccatgatttcaggcggcaccccggcaacggcgaacgagcggaatttcaacagcggcttaagcccgagtgattcagccttttctttatccatgagcattactgcagccgcgccgtcgcttgtttgcgacgagttcccggccgttacggttccggttaccgagaatgccgggcgcagttttccgagcgtttctacatttgtatccggccggaccccttcatcctgcgaaaagacgactttcttttcaacaagtttgttgtcttcgccgaccgaacgtaatgtgacctcaaccggcacaatttcgtctttgaatttgccttctgcaatcgcttttgccgctttttggtggctgcgcacgctgaaggcatcctggtcttcgcggctgacgccgaattttttggcgacttcttcggccgtatgccccatgcccatataatattccggcgcagtttctgcaagtcgtacattcgggcggacgacatgccccatcatcgggacaaggctcatcgattccgcaccgccggcaatgatcgtgtcagcgtggccgagcatgatcctttcggcgccgtaagcaatcgcctgcagcccggatgagcagtagcggttgatcgtaatcgccggcaccgtatccggcaatcctgctagggccccgatattgcgtgccatattgagcccctgttccgcttccggcatggcgcagccgataatcaaatcatcaatatttccttcatagttgccggcgcgttttaacgtttcttttacgacaagtgcacctaaatcatccggccgtgtttgtgcgagcgtccctttttttgctttgccgaccggtgttctcgcccctgcaacaatgacagcttccctcatcacattcccctctttccgtgtttttgtaaaaggccccttcatcaccgcatggggtgatgaatcggggttttcccatatacagccgctttccttgggagaacccctttatgttgtatgcgaaaaatttggacggaatcttttcctgccagaggatcggcattcgccaatccgtgtggctttaattccgtaacggttttccttttaacagcatgtgttgcatccgctgctgtgttttcggctgtgcaatcaggctcaggaacgcttccctttccaaatcgagcaagtattgttcatccacttttgtcccgaacggcactttcccgcctgaaagcacaaaggcgatctttttcgcgatttcaaggtcatagtcggaaatatagcccgacagatgcatttgctgtgccccgagcaacagcgccgcataaccggattcacctgtgaccggcactttttcgcggacagacggtttgtaccctgcgtcagcaaggcgtagcacagcctgttttgcatcataaatcagatggtcctggttaaagctgacgccgtccgtccggtcaaggaagccggactcgcgcgcttcttcagcagaagtggacactttcgccattgcaatcgtttcaaataccttgttcacgacattttgcaagtcaaactgtacgccttccggaatgtttttcaaatgcttgatgtacagctctttgttaccgccgccgcccggaagcaggccgacaccggtttcgacaaggcccatatacgtttcgcttgccgcctggatatgcgccgtatgcaggcacacctccgcgccgccgcccaaagtcatcgcaaacggtgctgcaacaaccggtttttggctgtatttgatcttcatcatcgtgttctggaactggcggacgaccatgtcaagttcaaagatattgtcatcctgcgcttccatcagcatcaaagcaaggtttgcgccgacacagaagtttttgccctggttgccgatcacaatccctttgtaatgattctctgcttcgtccacggcataattgatcatttgcaaaatgtcgagcccgattgcgttgctttttgaatggaattcaagcagcagcaccccgtcgccgatgtcgattaagcttgcgccggcattttctttcagcactttgccctgcgttttcaaagttttgagattgacttctttcggattggctggaaccggcttgtatgctccgttgtcatagtacgagacagcgccgttttcttctttgtaaaaagacgtaaagcctttttccagcatgcctttcacccagccgggcacttgaaggccgtcctgctccattttttgcacggatttttcaacgccgattgcatcccatgtttcaaacgggccgaatttccagccgaagccccatttcatcgcctggtcgatggcgagaatatcgtcggcaatcacgcctgaaagttctgccgaatacacaaggcaaggcgcgagaatattccagagcagctgtccggcacggtcatccgcatacacaatcgttttgattttattggcggttccttttgcctgccgggccgcttccaaagaagccgctttcattttcgtgcgttcgccgtattccagtgtttccggatttaattcatagatttcttttccttttttttcataaaagcctttgccggttttgctgccaagccagccattttcaacgagtttgtgcatgaatgccggcactttaaaaacttctttttcttcgccttccgttttttcatacacgttattcgcaacatggacgaacgtatcgatcccgaccacatcgagcgtccgaaatgttgcgctttttggccggccgatcaccgggcctgtcacggaatcgacttcgccgaccgtgtagccgcctttcatcatctcccgcacggtgacaagcaggccgtatgtaccgatgcggttgccaataaagtttggcgtatcttttgcaagcacgacgccttttccgagcacgtcctcgccgaactgcttcataaatgaagtgacgtccgggtcggtgtcagcggtcgggatcacttcgagcagtttcaaatagcgcggcgggttaaaaaagtgggtcccgagaaaatgctttctgaaatcttcgctccgcccttctgccatcgcttcgatcgaaatgccggatgtgtttgaacttacaatggtccccggccggcggaagcgttccactttttcaaatactgattttttaatatccaaacgttctgtgaccacttcaattatccagtctgcttctttcagccgttcaaggtcgtcttccaggttgcccgcttcgatgagcgcgaggctttttttcgatgtgagcggggccggtttttgttttaacagcttcttgagcgcagactggctgaagcggtttcggacggctttgtcctccaatgtgtacccctttgctttctccgcttccgtgagtgcgttcgggacaatgtcgagcaaaagtaccggaatcccgatgtttgccagatgtgcggcgatgcccgatcccattacaccggaaccgatgacagccgctttttgaatggtataccgcatagtgcatcccctttctttttgaatgaatgctcattcattaagcgcttaaaaaaataacgctttcatctttaataataatatatacgaattttttcattctatcaatcacttcatctcaaaaaatcgccattttttaaaattttttatatgtctagccgttttgggcaagctaaacgaaaagcgtggggaggtgaaccaatggcaaagctaaagaaaaatccgtcaaaagcgggtgtgagcgcggcaagcgtaaaaggcaatgccggcccgacagtggagcgtgacggcggcggaaaagtaaacagccaaaacaaccagtacaaaaaataagcaggcggctgcataggatccgcagctcattcaaacaataaaggaagacttggataaaggaggaaatggaatgcaacaacagcctttttcacagcagcaaaacgggcaaacggtttacaacgccccacccgatgtcatgtcaacaaaagatttggcctatgtggatgatatgctggcctggaatctgctggcgatgaaaaaagcgcatgatgcggcaacgcgctgccaggacaatgaattgaaagctgtttttgaagcatgcgggcaaatgcaccagcgccactacaaccagattttgggtcatttgaaaagccacttgcaataacaaaaacgaatgccagcccgccacaaaaagcgaaccctgcttttcccgttcataaagggcatgcgttcgcagccggaaaggggcaggtaccccgctccggaatgcgcgcacagctcgggccaaagaaaaaagcaggctgtccgtccggggcaaccgcacttcccggcctgaattggccgccccggcaaccgtgattaacggaaaacgggcgctgccccgtccgagccctggcaggcgaatctgcacgtgtctcgcggcagagatacctaaatgcggaacgcgcataatacgaccattttaaaaaaggaggtacaacatttggattcccaacaacagcagcagcaaaaaattcaaaacccgaagacacaatttcctgaaacaccagaaatgaacgaccgcgatcttgccaatgacctgctttcgatggaaaaatatatgaccgcttcttataatactgctatgaacgaagcgagccacgaaaaactgtatcgcgatcttctgaccatttttacggaaacgcagaatgagcagcgcaaattgtatgagacgatgttccaaaaaggctggtacagtatggaagcggcagaacagcaaaaactgcaacagtctttccagcagcaccaaggctacgcttcgcaattcccgtacggcgggcaggtgcaatagccgcaaaaaacaggcggcacgatgccgcctgttttttatttttcgttagaaaacatatattttctgtaatggtaacggattgaaaaaataaatccgaccgcaagcatattccccatcagcgaactcccaccgtagctgataaacggcagcgggatcccggtaatcggcagcacctggatcgtcatgccgatattttcaaacacatggaacgtaatcatcgcaatgacgcctgcgcaaatgtaggaataaaaatcatttttcgtctcaagccctgcttttataatatggtaaataagcataaaaaacaggccaataacaatgctcccgccgataaagccgaactgctcgccgatcacgctgaaaataaagtccgtctggttttccggaaggctcacttcagttgtgccaagcccctttccaaacgtctggccggaaccaatggccaaaagggactgaatcaggtggtagccgtctgtattggaatagttataaggatcaatccaggcatagatccggccaaactggtacgaacggacgccaagatatttttcgagaagtgccggctgccagaggacgagataaaaaatcaatcctgccagtgccgcgccgctgctaaaaatcggaagcaatagtttccatgtgatgcctgacacaaatacaagcccgaaaaatatcgcaataaacacaagtgacgttcccaaatcctgcccaatggtcaacatgagcggcacaaacaagcagatgccgagtttcacaaacagccagaaatccgattttactgaccggttcagcactttttcattatgatcggaaataaggcgcgccattgctaaaattaaaaatggcttcatgatttcagaaggctggaatgtcccaattaccggaaacacaaaccagtttttcgccccattacgctccggggcaatgctggctggtgccaggatcagcaaaatcaacagcaaaatcccgaacccgtaaccgtaccacgatatttttttcagctggtcggagtcaaggcggatcaccaatgcgataatgatcgcgccgaccacatagttgatgacttgttttatcagaaagctgctgtcagccgtataaatggcaacaaggctgacaatgcagaacaacatcagcgttaaaaccagcccgtaatcaattttagaaccttcatcccgcgaagacaattccatcacctgacttctcaatgccggaaccgccggccgtaaaataaaataaatgatacggatccttcaaaacaactgacccccatcattttttcatacaagctttattatacatcatacgtgaagaagcacaatccttttcgttttggaaatatttctttggcaggttgaaaaatgttgaaattcctctgctgctctatatacaataagaaagaatgatgaaaggatggagatggtctggagtggaagcgattaaaagtgcggaagaatttaaaacggtaacgggaggagaagcaccggttatcgtgaaattttatgcagattggtgtccggattgcaaagtgatgaatatgtttattggtgatgtgatcaaggactatccgcaatataaatggtatgaaatcaacagcgacgcgttccaagcgattgcggatgaaaaccaggtgatggggattccgagcctgctcgttttccaaaacggcgagaaaaaagcgcatctgcacagtgcaaatgcaaagtcgccggaagaagtacgcgaatttttaaatcatgtcgtattgtaaaaaaaggacccggagccggggaaggcgttccgggtcttttttaatacgttgtcagtttcagcacttcctggaggcggtaaaggacttttaacaaataagtggagaagccttcgtgttttttgtacgggacggtaaaagcgccgtcttcattgttccacagccgcccgaagtaccggcggatctcttttgtgatggccgcatcattcggtgccttcacaaataaatcggtctccaaattataatcgtccaggttgcgaagcgttaaattggtcgacccgccgaaaaagagcgagcggccgggcttttcaatccagaccagcttcggatggaattgctcgagcccggtattataccagcggattttgatctttccatccgttttctttacgagttcctgtgcaacaggctggttgggaagcccgatttttttatgcccgaacgcgtttaaattcgggtcgaggataagccggatgcggacgccgcgggaagatgccttctcaagcgcacggaccactttccggtcagccaaataaaacatcgccatcgaaatcgaatcgcctttttttgtcgccttgatttctttcatcatccggtcgtaaactttcccctccgttaacagctggacggcaatcctgccttttcccctctctttccctttgtattgcggcagctccgggccgtccgacatatcggaagccgcctgctccgattccagaacatcccgaatgaccggcccttttacaagaaaagcgatattggaatgccagccgcttgcgtcatgcgggttgccggatgcaatgaccgtgccgttttcagtcgtaaacgttttgcggtggttcgctttaatattaaaaagttcaagatacgagcggagcgtcatcttcggcgcattgtccccgaaagcatttggcagccagccggtcccgccctggccgaaccactggaaaaacatatgccaaatcccggaataaagcggcgtcgggtcacgcagcgagtccaaatgcgtaaagaccacacggatgccatgttcctttagccgttttaaaatgccagcttcatgggacccgtaagaagtattgatcggatcggtgatgacgatgatgcggataccaggttctttttcttttttggcaatcagcctgtccacgagcctctcagcaagcggcggcactttcatcttttgatcatggtagccgttaaaaaggaagagatcggcgacgatatattgatgggcttggtcaatcatccggtaaatttcaggatagacggtctgctccacctttctttttcctgtccccttttcccggtatgttaaatccgaaagaaaacggatgtcttgatcgtgaacgttatatgttctgccttcataggaaatcccttttggcagcggcttatatgtatggtacagcatgacagccgcataaatggcaattaagacaagcaacccataagacagccatttctttccgctttttttcattataaccctcccgttttcctgtatctttcccttacaccacgcctggcaaacatgcaggcaagcgtttgaaaagcaacggaacgggtaacataaaagtactttaatttagaaaggaaaaggctatatgatctggacaattattgggattttgctcgtactttggattttaggcattgtttttcacatcgccggcgcttttgtgcaccttctgcttgtcatcgccgccattgtgctgctgtttaaaattttttcaggcatgcgcggaaataacagccgatagaggctgagggtatagatatataaaataaacataagtttttacatcaagcccgagcaccaatttgcatcatgactactttttacagtaggcaacagagctaaagaaattttgttcattttatatagaaggttgagccgcaccaaaggctttaaccttctttttttaggcaaccctttctttatccaatattccttccttccgaaagctccgctctttttccaagcgatgcatcaagtactgcaattctatcctgtatctatagaagatgccggaaaatactggcgcatttccgggtttaaaggtataactataatggagataggctagcccatttctatccggctctagaacgaaaagacaaaggagtgttgtaaacactgtgaagaaaatcatccagttttgcctaaacaacaaatttgccatttggctgatgaccctcattgtggcgggtgctgggatttatgccggcatgaatatgaaaatggaaaccattccgaatatcgacgcgccatacatgctggtgacagcctctgatccgggtgccacaccggaagaagtcgaaaataaaattacgcaaccgatcgaacaacggctgaaaaacctcaccggcgtcaatacggtctccacttcctcgacggaaagcaattcccagatccagcttgagtataaatatggcacggatatggatcaagcgaaaaaagacatccaggatgcgctcgaaaaagtggacctgccggataatattgacaagccgtccgtaacaaggatcagcatcaatgattttccgatcctgtctttaagtgtgtcggataaaagccggtcttttcagcacttaacgaaaattgtcgaagaggatcttgttccaaaactgcagagcattgacggcgtgtccgatgtgcaggcttccggccagtacgtgcaggaagtccagctgacctttaaacaggacaagttgaatgcactggggctcgatgaggacactgtcaaaaaagcgatccagggcgcaaacgtttcggtaccgctcggcctcatcaacttcggaaaagaaaacaaatcggtagaaatcgatggaaacgtgaaatcgctgaagcattttgagaatctgaaaatcccgtacaccccgaaaacgggtgcagcttccgcttcgtccgcagccgcgcaggcttcaggggcacaatccccaaatgcggcgcagacttcaggaacgcaggcctcgggtgcgcacgcttcaggggcgcagcaaccggcgaatgcaggaacgcaagcgacgcaagccaacgtcggtatgccaaccgttgcgttaaaagagattgccgatatcaaagttgtcggcaagcatgaatcgatttctaaaacgaacgggaaagattcaatcggcatccaaattacaaaagctccggatgcaaacacggtggatgttgccgatgcagtaaataaaaaagccgcacagtttaaagcggactataaaggcacacaaatttccaccattctggaccaggcaacacctatcaaagactccgtcaaaacgatgttcgaaaaagcaatcatcggggccgtatttgcgattgtggtcatcctgctgtctttgcggaatgtgcgttccaccattatcgcggtcatctcgatcccgctctcggtgctgattgcttttattattttgcaccagcttgacatcacattaaacgtgatgacactcggagccatgacggtggcaatcgggcgcgttattgatgactcgattgtcgtcattgaaaatatctacagacgcctgacgttgcgggaagaaaaactgcgcggaaaagcgctgattcgtgaagcgacggttgaagtttttaaaccggttatgtcttccacgatcgtaaccgtcatcgtctttgtcccgcttgcacttgtgagagggatggtcggggaactgttcatgccgtttgccctgacgctaatttttgccttgctagcatcgcttcttgtggcgatcacggtggtgccgatgtttgcccattcgttatttaagaacgggttgaagaaaaacacgcggactacgaacgaagggcacggccggatcgctttattttacaaaaagattctgaactggtcgctcaaccataagctggtcacgttcggcatcgcatgcctgcttcttatcggtagtttgtttttaatcccgcttatcggcgtcagctttattgaaaacgaaggccagaaagtcgtgtatgccacctatgcgccggaaccaggggaaaccctttccgatgtgaagaagatagcaggaaaagcggaggattacttaatccaccgtaaaaatgtaaaaaatgtgcaatattccattggggagtcggctttcagcaccaacagcaactccgccatctttgttgtcgaatatgaccaggataccaaaaatttcgaccgcgaaccggaaaaagtcattaaagccctgcaacaaaggacggaccagggtacatggaaatcacaggacttcgcatctatgtcgaatgatgatttaacgatgtatgtctatggcaacaatctggatgaaatcaaaccggtcatccataaaattgaaaaagtcatgaaaaacaacgacaacttgaaaaatgttgaaaccagcctttccgaaacttatcagcaatacacgcttgtcgccaaccagaacaaactggctgctctcgggttaacagccggccagctcggaaccggccttgcgcaaaccggcaaccggaccgtgcttacaaccgttgaaaaaggcggagaagaattaaatgtttacgaacagaacaaaaccgggcattacgacaatattggcgatctgaccaatcaaaaagtcacgtcgcccctcggcacaaaagtagcgctaaaagatgtcgtggacgtgaaaaaaggcgaaacaccggatgcagtctcgaaacgggacggcaaaatctatgccagtgtaaccggcaagatcaagacagctgacgttgcgaaagtgacacaacaagttcaaaacaaagtggataaactcgatattccaaaatacatccatgtcgaaaccggcggcgtaacggaagacatcaatgactcgtttacaaagctcggttatgcgatgctggctgctgttgcgatcgtttatcttgtgctcgtgattacattcggcggggccctcgcgccgtttaccattcttttctcactgccatttgccgtaattggtgcactggtcgccctgtacctggcgcatgaaacgatcagcgtcaccgccatgatcggcgccctgatgctgatcggcatcgtggtgacgaatgccattgtgctaatcgaccgggtggtgcataaagaaaaggcggggctgtccacacgcgaagcattgcttgaagcaggcgcgacaaggctgcgtccgattttaatgaccgcttttgcaacaatctttgcactgatcccgcttgctctgggctacggcggcggcgggctcatttcgaaaggggtcggcatcacagtaatcggcggcttgaccagctccactttactgacacttatcatcgttccggttgtttacgaatttttaatgaagtttaggaaaaaagaaaaacatccggaagaagtatgaaaaaagaggttgcccaggggcaacctcttttttctgcatgtggaagcatcaccagcgcttgcgtcggagaggtaaaacttgggaaagccgggatttacctgcaaaccccagttcctgttcgatttagcttctttcaagtagggatgaataagcaaaattcttaaatttggtaagaatgctggaggccggtttttttcgtgcttctttaacgtagacgcgctctatgtgaaggaagaccctcgtttttgcttgcttccttaacgtagacggggtctatgttaaggaaggtcttcgtttttccatgcttccttaacgtagacggggtctatgttgaggaaggacttcgtttttccacgcttccttaacgtagacgcgctctatgtgaaggaaggacttcgtttttccacgcttccttaacgtagacgcgctctatgtgaaggaacgccttcttttttccatgcttccttaacgtagacgtgccctatgttaaggaagaccctcgtttttgcttgcttccttaacgtagacgcgctctatgtgaaggaaggtcttcttttttccacgcttccttaacgtagacgtgctctatgtgaaggaaggtcttcttttttccacgcttccttaacatagggcttgctgaatcaccaaacttcctagatttggaaaaacttaatacaatgtgcaagggttaaagatggattcttctatattttgaaaaagagcttgctgacaaattgggtacaaattcagaatcggattcgttcaccaagccccaagtaggacatttcgagccaggatgcagctccttttgtccttttggcagattcaaaaggacatttcgggctcggatgcaacgtgttttgtccttttgacagcttcaaaaagacatttcggacccaaacgcgactccttttggtccttttacatcacgcaaaagaacaatttgacctcactgtacggctagtttctctttttttgccaggtccgctgattcgcatccttgctgaagaaattaaaaaagccgacctatctttcaggtccagcctcgtaaacgcaatgaagattcattttttagcaaacgctacaaaaacggccattgcaaaacccgaaagcccctaatttcccccaagaatgatcgcagcgggttcgggagcgggttttccaatatagtacccttgcgccaaatgcatgccgatcgatttgcaatagagcagttcttcttcgcgttcaattccttccgctagcacataaataccggtttctcccgcaatttccatgacttcctgcaaaaagcgctgtttgaccttattctcgtcgcaatgggaaatgaaaaaacggtcgattttcacatagttcggatttaaaattttcaaagtttcaagcgttgcgtaccctgaaccgagatcatcaagcgccacgccgacgccaagatcacggtagatcccgagtatcttttttaaaaagtggacatcattgatcttctcggtttccacaacctcaaagacaaggtcctccggggaaatatcgtactgttcgatcaaagtaaacgtatgccgcaagcaaaacttgtaatcataaatcgaagcgggcaaaaaattgataaagctcttcacgccgcggggcagtttctcagcacgggctttcagtgccgcttccctggcgcgcaaatccaataacgaatgcagtccggttttatgggcgacatcaaataataggcccgggggaatgttccggttcggcaaacgggtgcgcagcaaagattcatagccgtatatttggttgtcctgaatgcggatgatcggctgaaaataactcgtcaggctgccggaaataattacttttacaagcatctcatagcggatgcgctcttttaattgagaaagcggcagggagagcaccgaaaatccggacccggacggatggacactggtgaacagatcaaccgtttcgggcatatcttttatgatatcaaataaagtatccttttcttcaaacggaaccattaaatgctcggaaaggacttcgtatacacaggatttctgcgtcatatattcaatgacagcctgtgttttttgtatgtataataaaccgctttccggaatataaaaagatgcatcgttctccaggtttggcttctcattcagcatatgattcatccttatccagtcgtttaacttatttataccaaaaaatgcccggcaaagccactattaaaagcaggcggcatcatcccggccggaaaaatcgtccaaaagcgctttttctccctttcctattccgcaattgagaattaaatatcgaaaatgaaaatagaaaatttctatctcacttctatttccaccccttttcttttgatataaaaaactttactttaaatttattataaataaatattgatttttataatgaatcagttataatatagacatcaaaatagcaaaaggtgggaaaatgatgagtgatcaaaaagacaacaaaaaaatgacaactgcattcggtgccccggttccgaatgacacagattcaaaaactgccggcaaaagagggccgttattgatggaggatgtctggtttattgaaaagctggcccacttcgaccgagaagtgatcccggagcggcggatgcatgcaaaaggttccggcgcctacgggacattcacggtgacaaacgatataacgaaatatacgaaggcaaaacttttctcaaaagtcggcaaaaaaaccgatatgttcatccgtttctcaaccgttgccggcgaacgcggcgcggcggatgccgaacgcgatatccgcggaacggccatgaaattttacacagaagaaggcaattgggaccttgtcgggaacaacacgcctgtatttttcctcagagacccgaaacgtttcccggatttgaaccatgtcgtcaaacgcaacccgcgcaccaatatgcacagtgcacaggcaaactgggatttttggacgctgcttcctgaagcgctccaccaagtaacgattacgatgagcgaccgtggcattccggcaagctaccggaatatgcatatgttcggcagccatacgtacagcatgttcaacgcaaacaatgaacgcgtctgggtcaaattccactttaaaacacaacagggcatcaaaaacctgacggatgaagaagcacaggaaatcatcggccgcgaccgcgacagccatcagcgcgatttgtacgaagcgattgaaagcggcgactatccgcgctggacgatgtacatccaggtgatgacggaagaagaggcgaaaaaccttccgtataatccgttcgatttaacaaaggtatggtaccataaagattttccgctgattgaagtgggtatcgtggaactgaaccgcaacccggaaaactattttgcagaagtcgaacaggccgcgttcgccccgaccaatattgtgccgggcatcgggttctcgccggataaaatgctgcagggccgccttttctcttacggcgatgcgcagcgttaccggttaggcgtcaaccactggcaaattcctgtcaactatccgaaaaaagcggaacacttccatccgtaccaccgcgatggcgcaatgcgggttttcaatccggctgaaggcggctccgtttcatacagcccgaacagttacggcgaatgggaagacagcaaggagcacgcagaaccggcactcgatattttaggtacggctgactatcacaatttccgtgaagatgacgacaactattatgaacagcccggcaaactgttcaggctgatggcgccggaagaacagcaacgactatttgcaaacaccgcccgcaatatgcagggaacgacaagagaagtccagctccgccatattacgaactgttattatgcagatccggcatacggcgagggcgtcgcgcgcgcactcggcattccgatgagcgaagtagaggcggctgtttcgaggaaataactggcggatgaaggtttgcggtgccgctaaatgcacatttataaaatgctcttcagtttttgcatcaagcccgcgcaccaatttgccggatgatgactttttgcggcaggcaaaagagcggcaacattttgttcactttatatagggcttgctgaacgaatccggttctgaatttgtacccaatttgtctgcaaactccatcgcaaaatatatgcgaaaatgcgtgagtttgtcttctccatacgttgaatcggctttcgcgtgcaggcatttccctggatttgttgtaaaacctttgcatttaaatggttgccaaagctgtcagcatcctttccaaatctaggaatttcgcttattcagcaagccctatatagatataaaatacaaaagacgttgaggcaccatttcgatttgtgcctcaacgtcttttaaattgatttagagtgacagggcacagtgctagatggtgtcccgccctcttttcgattgattttgctcgttcatttatatcctttttttgtaattttcgcccatatgtcatgataccagccgatcagcatgctaaaagccgggtcaaacaaccctttcattttttggatggtccatactgtgaacaaggcaacaataatgcttgccgcaatatcccccggataatggtgcccgacccatacacgggaaatgccggtcaaaacggcacagagcatcatcgctaatccgagtttccggttccgcacccataaggcgaaagccatggcaaacgtgcctgtcgcatggtcgctcggaaatgagtcgtcggccgcatgcggaattaaaatgctggtatgatacgtgacaaatggccgcggttcataataaacaagcgtaatcacataattgaccagcaaagcggcaacaccggcaatgccggcataaagcaccatgtttttcattttatcattgcctaaaaaccacacaatcaataaaacagcggcaaaaagcggcaaggcatcctgtgtaaaaaaaatcatgatgtcatccagtaatttttcatgccctgacaagttgtggaccataaaaaacaatctggcgttctcattcatggctctatttcctttcttctatggctggttttgatagaaaaatgtttgtcaaacatctcgtccatccgcacgaaccggaagccgcgcgcttttaatgccggaatcgcaacccgcaaaccttcaattgtatactgcggggcatcctcatctgcgcccggcgtgacgccgcaatcatgcagcaaaatcacatcgccgctttccacccgggtgatcaggccgtttgaaacctttttcgaaccgccttttctcttccaatcgcggaacattttcgaccagtgcaccatgcggaactgcttgtgcagaaaaaagtccagcagatgcatcattccccacggcgggcggtaaaaaaccggtctctcgccggtgatgttttcaataatccgtgccgactgctcaagcgtgcgcgcatttttccaagggctgatcagccagttgcactggtgcttataattatgaaggccgatacaatgcccttcacgcgacatgcgcaaaacgagttccggataccgggccgccctttccccgacgagaaagaaagtggccttaattctttcccgctttaaaagatcaagcagtaccggcgtatagaccgggtccggcccgtcatcaaaggtgagcgcaatctccgcatctttttttcctttccaacatacccaaaaaccgagtttggccgctaaaacatatggaataatagcatatatgagaatgaataaaatcaatacccagatgatgacttccaaaccgtgccgctcctttcatccaaagattcatgcgggtgatgcacaagcaaagccttttttcgcatccttgcatactttccgtgcgcggtatccggcatttccggatcagacgcatgaatgagccgtgcatatttcgcctggtcaataacggaaagcacccgaaaagcggcctctctgttttgaatcgatagcgtgtttcttttcatcttcgcaagctgtgccctgttttcattcaggcgggctaaacaccggattaacgtgccttcatctgctgcctcaactgctgcgcccgcttgtgttaaaaaggctgcgttatcttcttcctggcccggcagcgctttgtataaaatcatcggcagttccatggccaatgcttccgctgttgtcacgccgcccggtttcgtaatcatcacgtccgagacagccattaaatcacgcacataatcaatatagccgagcacgaaaaccttgtgtttcgtccctttcagatcatccatcaggcgggcgcgtagtttttcattatgcccgcacacgatcaacagctgcatgcggaaaggtacctcgtccagtttttcagccgtgaacagcccgtccccgaacaggccttccccgccgcccatgacaagcacggccggcaacgccggatcgaggccgtattttttgtacaaagcctgcttgttcaccggtttcaggaaactcggtttaatcgggatccctgtacaggaaatttttcggccgggaatgccgagcctgatcaactgccggcgcaacatatgcgaaccaacgacatagtgatctgtgtacgggtgcagccatgaactgtggtgcgtatggtcggtaatgacggtaacgagcggaatatccgtaagcccgtattcctttaattttgaaatcatagaagacgcaaaaggataggtgctgacaataacggatgggcgtatcgtttcgagcatccgcagcgtctttctcatccccgttgaaaataagccggtcaatgtttttgacagggcattccttccatacgttttacggtacaaatacccgtaaagattcgggaacttttcaatacctttcatataaacatagtggctgaccgggaataaggtgggatggacccattccatgaaatcgacgacaaccgggtctgcttttggggaacgaattttcatcgcctgttcaattgcccgggcggcctgcaaatgcccttccccaaaagcgcctgttaatatcaacactttgtcttttttcttgttggccattctcttttcccccctgcttttcggtctgtttacagaaaacgcgccgcttctccttctcatgcggcctctttcgatacaatacaatagactttgagggtaaaagaaaagttcatttataggcgataaaaatttgcggtcattgttttcctactcttccatttaaacgaattatggaaaacactgtaaaaatttgcttcgaaaaaaagaaacaggcaaggcttttttcggaaacaaaaaccccgtttggaattttttttcaacaaggacaggcaaaaaaacgcaaccgggtactcacaaaaaaacatgcggctccttattttgcggccgcatgttttttcctgtttctccatttttgaaatagccatgtgaccgaaagcccgagcgagtaccagaacaaaatcaggaaaatgacttccccgacgagtgggatgctgcaaagggcaatcaggatcgtcacacccgttaacagtttcagccattcctgcctgccgtttaaaacggcaaaggtgctaccgatttcccggccaagaaacacgagtcctgccaggagggatacaaaaacagcaaggcataacagaaggacaaccggtattaataccactgtaatcgtcaaaaacaggctgagcgcaaggacgacaagcgacagcaggcagccggtaatgatcatccttccgggccgcgtgtagaaggaccgaatcccagaaaaaaacggttttttcgcgactaagccgaacaaaacagtgcacacaatcaacagtaggcttgcggaaagccggaaaaaccagagggcaagaagcatgacagcggcaaaaatcatactgtcaagcgttttattgttcatatttatagataggacatgttccgttacacgggcacccggctgctgtttgatatttccaccgagcacaaatacagagccgcggatatccgctgacttacgaatattcaaattcccattgatcacaatgacggctgttttgacatatccgctgacggtcgcgttattcccgatcacaacgacattttcgactttttcatttttcgggatgaccgtatgccggtcgtggatgataattctcattcttttttcctttgcaaacgcagggtggaaacccgcccctgcgctcagaaaaagcaggagcaaggacaataggcaaatcaatatttttgcggctttcatctttttctccatcccctactccttcaccggcttcatggtgagaaggccaaacaaaatccagatacaaacggccaaaatcaccgccatcaccaccataatccccgcagacaaagccgggagcgcggaaagaatggaaagcgcaatatgaaagccgcttgaaagaatattgcagagggcctgaaaaatattcatgccgacataaaacggttttctcatcaccgggtaggcgcaaagcacagaagcggcacagcaaaccgcaaagaaccagacaaaaacgcggtaatgcatcgccattttttcctgcggcataattttagccagaaccgccttttcaaactggatccccggtacatcaaccgaatggtaaaaacggctgatttccgtcttcaccgtctccagttcttccagttcgcggcggcaatccgggcaaagggcaagatgggcttcaaccatttttcggtccgtttcacttaacgcatcatccatgaaggccggcaataaatcccggacgtgtgtttccatgtgatcaccctcttgaaagttcttttttcaaaatatttctcgctgtgttgatgcgcgacttgacggtaccaagcgggatgttcaagatgtctgcgatctcttcataggaatagccctggatatcgcgcaatacgatcgctgcccggtgttccggcgacaatttttccatcgcgctgcggatgtcaaatctcaaattggcgttgtcgatattggaagttggcctcctaagtggctcctcttctatttccgcctgaagatccactttttttcgcatttttttcagccggtcatagcataaatgagagacgatcttcgacatccaggaggcaaaagcataggcatgttccagtttatccagggcgtaccaggctttcacaaatgcttcctgggcgatatcttccgcttccatcctgtcgcctgtcatggcatatgcatgccggaacacctcccctttaaaccgggccaccagcacggcaaacgcatctgtatctcctgcttttgcctgccggatcaactgtgttaaatcctgctccaccattttcaactccctgcttaagcaacgcgatcttttgtcgttgcccgggcatgtgcaaaagcggccgggaaattgcaggtgcacttgcccatttcattccatgttcattatggcatattttcctttccgccatcaggaagtttttttcatccgcttagcgcctcatttggataggagtaccccataccggccggaaaacgggcggcaaaaagccgatgcaagcgttgggccggcctgaaacatgcgcccgaattccacggcaggaagatggtaaaagtacccggaaacaaaaacgacaagtcctttccagcaatacggccccataaacgccccgcaaaaaaatcaataagaggttgaaacatagtactggtccttcagcactttatccggcgtttggtttgctttgcggccgagcagaccgcggatcaatacatcaaattctttccccctgagttcgatttcgctcccgtattggcgcatccgccggtaaaaccgggccagttgcttcccgtcttccaagatttccatcacctgttcctccaccggtttggtgaagtccaattcaaagacaagaccgtgttgtttcaaaaaagcaagattgatttcttcctgaccggggaggacggagtggataaaaatcggcagctttttttgaatcacttcgctgatcgtgacaccgcccggctttgtaatgatcgcatccgcttcatcgtacagccggctcatttcctttctggactggatatagggaaccgggatgatatgtttcatcccccatccattcagcttgttatacaatttttcgttttttccgcataacacataataatcggccctgcccggctgttcccgtttcaatgctttcagaaggcggtacagatcgccgaggccgctgctgccaccggatattaagattttttttcgtgacgtatggcgcaaaaccgttctttctttaaacgcttcatgaatcggaatgccggtgacaaaaatgttttgttcgggaacgccgttacagatgagcgtcgttttgatcgtttggttcggcacaaaatggatgtcaatttctttctttccccacaagccgttgacgaaaaaatcagtgtatgcattgataaccgggacatcaatttttccttttgacttcagccggctgagcagcatcgacggaaaactatgcgtgcaaatgacaagatccggattttcctcggcaatcagtttttccatttgcttaataaaagagagttcatagaatttcattaatgcggtctggtcggcatccgcataaataaaatgtttgtacacccattggtatgtccgcggtgctttctggatccatttcaaatacattttcgtgacgattttctccagcgtcccgctcgtataggaaatcaaatcaacttttttcatttcaatggtactgtccatacatttcaatttatgcattaacgcctctgcgacctgatgatggccggacggcatttttaaaagcggtaaaatgagcactttagccaagctgtcttcctccttttccggaagcctgttctttttacaataaatagacttccgcaattgccgggaagttcattctgttttttaccaaaaaagcagattttaaacaattgaattgtataccggatggatgtcttacaacaagtattttgccaatattggccgtattttgagcagcagccgcctgcacggcttttaagggcgttttggaccaacatttcacctccttaaaacgaccatgcaaaaggatggaaatcaaccgacaattttttctaaatatatcgcagttctgttgcctgctgtaaaaaacagtcgtcgtgcaatttggtgctcaggcttgatgtaaaaacttatatagaaccgtgctgcgcggtatttcgctcggaaaacctttcacgtaaatcaccggcaggcttgtcgccagtttcccgcgtgccgcattggttgctgaaaaactgcgggttttttcattgaattctcacggtttattcagaataagccgctatactggtcccttgagaaacctggaaaattatgcaagaatacgaagtgcaggcggcggggcatgataaaaaagactgttttcatgcaccactaacctattacacgccagagaatggattctatgcgtaaagaacattacatgaggtgagtcctccatgttcgtgaagaagataaccattagtcttttcagtatcatatttacggtgtcatgcgctcttatcacaatcggcagtttctttatcgcaccgctgtgggccaaaaaagatgacccgcatttcgtgctgcttgatggaaaatggaatatttcaacggggcagatggcagcgctgttcctcttttccgtagtggccatcctgttttatcttggctgtttccgcatttttgcaaggctttcagacaaagggctgaaaataatggcagcctttttgtttgccattattttgtctattgaaacggcgattcttatcctgtttcacggggtgcagccgcccaaggtggatggtggccatatttatctggaagctttgtatttattaaagcacgggacattgctcggaaatgagtactatttacagctgtacccgaacaatgtaccgattaccattgcccgttacctgctttaccgctacctagcgtttggaaatccagactggtttttgattgtagataagctggcagcggctttattcctgaatatcgggatcttttttctctggctgctggcggtgaaaacatccggccgcaaaacgggaaatttgctgcttgttttcaccatcacatggctgccgctctttctttatatcccgtatttttatacagaaagccttgcgatcgcctttccgtccatggcggtgtatttttggtatggccacagtcggacggggcgcccggtatacctttttctgcttggtgcagtgcttgcagttggatgccaattaagggaaaatatggtattacttttgcctgcccttttgatctacatgctctacacgctccggctgaaacaaaccgtgctgcgaatagcgttcattatgcttgtttttttgcctgtcacttttggggcagaggcgtattaccaccatctcggctaccgggaaaacgcgaccatcaaggcgccggtaacccactggctggcgcttggcctttcaaatgaaggccgatacaatgtcgcggatacgagattgtcagaaagtcttcccacccaacaggcaaaaaaacaggcggattatgcactgatcaaacagcggatcgaaacgaggggtacatccggtctgctcaagctttgggcggtaaaagccttccgcacattttcacaaggcgatcaggcctacgccaagtacaatcagcggatggaccattacaacgccgcataccgttatgtttacggagaccagaatcaagtgctgttgtttatcatccaggtatttcatatcgcaacgctctttttgctggccgtttcgggcttaacgttcttccgtaaaataagatttgatgttcaattactcatgcaaatttgcttatttggcagctacttgtttttcatttttatttgggaagcagaaccgcgctactccctcctgttcacgccattgatgattttttgcgctgcacggggtcttgaaaagatgcatcagttcttggaagcaaaaaaatggctgccggcacaaaaaagatggaaactgcaaacagcaggaaactggctgctcgttttaagccttattgtcctgctcgccgtttgcgccaaatggaatgaaaaagcattcacaggaacaaccgaaaaatacgaggattatatcgtcaaccagcaggcggccagaggaaaacctgttgcgcttgttgaccggcatcataccgttacccaaacgtttatcgcagacaaagctttcgaccgggtcgcttttatgcctgcccgattccacggtaaagccgcataccgcgtttctttatggcataaaagcggcgggcggcaaaaaatggtgtttgaacgaaaatttacaaaccataagcgaaaaacaaacggctataaggcatttcttttgaaaaaagccttgcccggtgaaaacaggcattatgcactccgggtcgaacaactctacggaccggcgcatgcccggatgttccttcatgcgaacggcccaagcggacattttgagcagatggatttgtacggagggggccaattttaccaaaacggcaaaccgatggcaaaaacagaccttacgtttaccgtatcaaaacagattaccggtccccatataaaccggcacctgtacagatggctgtttggatgtgctttctttatgcttttactctatgggcttactgtcctgccgggaggggcaagcagaaaagcagctaaaaaaatccgcgaatttgcggatgcctgatcaaaatctccccgcctgagccgtttggcagcccggcgcttgaccaatagaaaagttggcagatgcgaaagacctgagccggcaacaaacgggaagcttgtggaggcctgaaccagcgggcggggaaaatttctgcgatcataccgcgcgctggcccggatgttccaatgctgatggaagccaaatcaaaacggcgagagcagtttctcgccgtttttttttgagaacatcttttaaaaatcaggatcatagctgatatcaaggtcaaaatggccggtgatgccatcgatcgttccggtttcggtgtactgccaaacgtctgcattcgtaccgagcgtgatgttatatcgtgccagccagattttggtattgctaggccaagaatctgtatggccctcaagatagcttttccaattaaagtagccggcataaatgcccactttcgcctgcccgagcgtctgcatttcatttaagaaatagccagcacaagccggggccgcatttgcccaccaagttgttgtaatgctattcgtcccggtaggttctatatcttcgaaagcgtagcccgtaaacgcatagccggttttcgcctttgcttgggccagcacttgataaaaacgcttggcttctgcaatatgctgtgcggaagtggtggtggaattgccgatcatatgataagcatggaccgacaagccggcgtttctggcatacttataataggtataaaacttcgaatccgtatatccgcttccttctgttgctttcagaatgataaaattgtagccctggctcttcataaggttaaaactgtcttgtgtcagagtttgataatggctgacatccagtccctttgtcgtcgtggcggatgcagtggctgatccggtactgcccgctgtggtcgttccggacgtagaacccgatccggtgttgcccgttgtggtcgttccggatgcagaacccgatccagtgttgcccgttgcggtcgttccggatgcagaacctgatccggtattgccggttgtagtcgttccggatgcagaacctgacccagtgttgcccgttgtagtcgttccggatgcagaatctgatccggtactgcccgctgtggtcgttccggacgtaaaacccgatccggtgttgcccgctgtggttgtgccgctcgttgctgtgacagaccctattgtgccggacgcagatccggacgtgctgccggttgccgttcccgtcgttttcccacccgctgccggtgcaggttttgtgaagtggctcgtataaatccagccactttgggttgtcccaacgacgcagatatgggacatattttgggtgctttctttcacatacacctgctgattcggtctaataacagccgtatattttgtatgggatgcagatgtatacagtttggaagaagcatagaccgtttttttcgcgagcaagccggttaagttgttcgcataaatatatccggagctattgcctgctttcacttggtaacgaccgtgcgacccattaaaaaccgacaccttttgcccatctttaatcgtcttgttatacgaatttccggttgcggatgtgtataatttagacggcatccacgtatattttacaaccggtttaataaaatgggttttgtcaacatagccgctgtacccggttccgatcacgtgggccagatacatgccgtttttcgttgcttccattttgatatacatcatcttccccgccggtacggaagcaacatacgggccgcctgccgcctgcttataaattttcgaaccaaaatagtcctcttttttcactttgctccttgtcaggttatcagcataaatgtaacctgttttcccacctgctttcaccttatagcgcttgcctgacttgctgtagacggttaccgctgtcccgctgttcacatttctggagtaagccgcgccggacgccgttttataaagcttcgacggtgtccacgtatacatggtagacgaggcggctgaagcaggcttcacaaaacttagcgcaaacagcaataaaaaacccgcacccccgaaaaaaatcaatcttcgcaatctgtctcctccttttgttctatgtatcaaacaccattataatcaataaatctcgtaaattttatcccgaatttgaaaaaaatagtgaacaatcattctaaatgagtctatatacctatacagggttacattttgcctatttgaaaggggatcgatcaaaaaaattgcaaaaaccactccaaaacggagaattgcctggattgagagaagaaatttatccgcagcaactgagatttaaaccatttagactgaaatatttccgcgagatcacgagagaatgataaaaagaatggtttggggggcgccacagtttttaccattccatagctaaaaagcattcctttcctttggcaagtggatcagtaccaaaaaaagaatgcttttcatttgctatgaaaaaaggtcgccaagcgtgaattaggggtgtttaagagtgaagcgtatctacgaatgatacaaagtgaactgctggccttctgtttcgaacggattttcttctatttcaaatccgagatcttcaattaactggtaatcttcttttgcgtcctggccctctgtcgttaaataatcaccaataaaaatggagttggcaataaatagccctaaattctgcaaagagcgcaaatgatattcccgcccgccagcaatccgaatttcctttgtgggattgataaaccggaacaaggacaaattctttaaacaacgaatcggtgtcaattcgtccatattttcaagttttgttcccttaacaggatgcagaaagttgaccggaatggaatcagcgtccaaatccttgagcgcgaatgccatatcaattatgtcctgatccgtttcccccatgccacaaatcacaccggaacacggggagattcctgctttttttacgttttcaatggtgttgaccctatcttcataacaatgtgtggttgtaatattcggatggtgatttgcactcgtattaatattgtgattaaatcggtccacacccgctgccttcagcttaaacgcctgctcttcagtaacgagtcccaaacaggcacaaatttttaatggttccacatcacgtttaatttcctcaactgccgcaatcactgcatccacttcacggttggttggtctgcgcccactcatcacaatgcaatatgtaccaattttattctttttcgcttcctttgccccttccacaatcgtttgtttgttgaccaaaggataccggtcgatttttgttgctgccttaatcgattgtgcacagtagccgcaatcctcagggcaaagtccgcttttggcgttaataatcaaattcaactttaccttttttccataaaaatgccggcgaatctgataggctccatggacaagtgccaatacttcatgatcacgaaccattaaaatttccttggcctcttcttcccttatcacatacccttcaatcaccttttctgccaatttcgaccaatccactaccgtcacccctttttatatgtcaacctaaaataatttatggtttacattaaaaattataagacactttcatttttggtcaagtactttttttatttttcacacaaaaggttaaaaaagtccggcactctaggaaaaaacaagaatgccggacgatttctattctatgaggcttcggaaacaggaatgccaggcttttacctcgccgctatcaaggcggccgatttcataaacgcatccaatgctgcccgcgtcggcaggccgtcattgtccccgagtctttgcatctggatggagcaaatcgcattgccctgcattaaaagcgcctgatcgtcaagatgctccagcatgccggccagaatgccggatacaaaaccatcacctgccccaatgcggtcaaccaaatgtttcacttcatattttggcactgccgcttcagcaaatgaaccatcttccaattttttctttgaatacgaacctttttccactaaattgatgatcacttgccgcacacctctggataagtaaaaatccgccatcttttctttttcatgctcgccggttaaaatctgtgcttcttttgcatttggcatgacgacatcacaaaggcaagcgatttcatttgtccgttccatcatcttttcttccgattcccaaattaccggacgcaaattcggatcaaacgtaatcgtaaggccgtatttccgggctttttcaatcagtgccaaagttgtctcgtaaccactttcgcttaatcccgccaaaatgccgccaagatggaggatctttgcttctgaaaaatcaacctggcgaacggcttcttttgttagtttagaagcagcactgttcttcctgaaataaacggtttccggatcgccaatctccgacagcccttttaacatgaaacccgttggatatgttggtgttgaaaaaacataggtggtatcaatgttctcattgtttaagaaatttttcacatatacgccgaaagggtcttccccaatctgcgtcaaaaacgaaaccgtgtgcccgagcctggaaaccccgacagatacattcacatccgcaccggccatataacgggtataatgtcggacagcatggagcggccccttttcatccgcaataaacaacacaagcggctcaccggcagtgatgatctcgctcatttgattcgcctccatataatttctaaataagaaattaagtttactatttgtattacaatttcattatagaggattatggcgattggtcaagaaattccggtattgtttttgtaaaaaaagaaagctcctctttggagaagagaagcttattgctatacattctatttcaactcttccattgggacaaaatccatatcatcataggtgatattttccccgcacattgcccagatgaacgtgtaattgctcgtcgctaccccgcaatggatcgaccaactcggggaaatcaccgcctgttctgaagataggataaggtgcttggtttcatccggtttgcccataaaatggaatacccgtgtatccggttccatgtcaaagtacaaatacgtttccatacgccgatcatgcgtatggcttggcatggtgttccaggcattgcccggttcaagcacagtgtaacccatttgcagctggcaggactcgcaaatattcggatgaatatattgatagattttccgcttgttcatagacagatcttcgcctgtttcacgcggcgtaatctggtcaatgctgatcttcacatttggatatttgtgatgcgcgggcactgaaacaacataaaacttcgccgggttagtggggtcgtccgattcaaacacgacgtcttttgtcccttttcctatgtaatagccgtcctgttttttcatcgggtcttttttgtcttctatcgtgatactgccgggccctccgatattgatgacgcccagttcccttctttccagaaagtagtctacaccaagttcttttgaaagccggatctctagcggctcatttgtcggtgtaaccccaccgaaaatctgccgatcattatgggtataagtcagcatgatttcgccgggaacaaaaatcttttccactaaaaactctttccgtaactgttctgtagtgtagtgccggatgtcttccgggctgtgggtatatcttgtttccatggtttgggacatttcaatcactccttgtgaattttttataaatcaaagttgatttaccacacgagccagccaccgtctactgcaagaatatggccggtcacatagtcagatgcagggcttgctaaaaaaatgatggcgcccattaaatcgaaaggttgtccccatctgcccgccggtattctgcttaaaatttcttcattccggttttcgtccgcacgaatcggggcagtattagcagtctcaatatatcctggggcaatcgcattgacctggatattgaacgtgcttaattcattggcaaacgctttcgtaaggcctgcaacaccatgcttgctggccgtgtaggacggaacgaacttcccgccctgaaaagaaagcatagaagcaacattgatgattttcccgcttttttgtttcgccatttcttttgcggctgcctggcttaagtagtagacgccatttaaattcacatcaagaacgttctcccagtcttcatctttatactccaacagcggcgcccgtttaataatgccagcgttgttcacaagaatatcaatcttgccgtacgtttcaatgcagccatcaatcactttctttgctgcttctttcccgctcaaatctgcctttacgagcacggctttcctgccctgtttttcaatgagagacttcgtctcctcgccgctcgaccggtgcaccggcaaatacaaatcggcccccgctttcgccagcgcaacggcatatgcctgcccaagccctgtcgccgacccggttaccaccgccactttgccttttaaactgaaaaagtcaagggtgaaatcgtctagatccatgtgaaagcctcctaataattgaaattataaaaaaaactgaatgccgacagtacaatctgccccgcgaattcacgatcatctgtcatttcccgcgctatgctggacgcaacaataacttagagcaatatagaaagataaatcatgacagccgttccttatcccgatctcccgttcctaaaaggaagccctgtaaaacgacatgcggcagagtatgacagaatagtacacttgcattcacagcttattcgtcgaaacacagcgaaagatgatctaaatggaaccaataaatacacctataaaacctcattactaaatgaacagagctgccttcttgaattttaagaaagcagccgcttatcaaaattttatgattataccaagtaaactgctgtgttttctatcccctgtttctttttatccttgaataaatgtacccttttcccaacgaccgttttccaaatcatttgcaatttgtttaaatttatcatcaggcaaattatataaaagggtgataataattgcagcaagtagtaaagcgacagccggataaatcgtcattgcccctttaattccaagcaatgttgttgatgattgatgggcattcgcaatatatcccgttgcagcaagaatacctgctgaaaccaatgctgcaatagattgggcaatttttctcgagaagttaaaggcagcataggtaatcccttctttacgtacacctgtatgccagtggccgtagtcaatcgtatcagatacaaaagcccaggtaacaccgttcggaatggctaaagccacatacccgatcgtaactaaaataatgaatgttacaatgtttgttggaatgacaaaattcaatgcgtccgcaacgactccaatgataagcccgccaattgctgtttttttcttgccaaacttttttaccaaaaatgggatgagtgtaatccctgcaacagagcagcccatcatgataaaattaataattggttgcaaaccgatgttattcagattgtatttacagaaataaatcatcatttggttgtttgtattcatagcagaaattgtaaataatgtcattaaaatcaggctccacagcggcctgttcgtaaatacgacccgaagataatctttcatcgtttcgcgttctttgcttcgtgaattttcagcatgaatatgttcttttgtattgatatagcatataaagaaaccgcatataccaatgaaagccataatagctgcagtaacggcataacctacttttgtatttgagaacaacagcataattggaacaaaagcaacaccagttaccaattgggcgccaattgagccggcctgccgtgtagaagccatgaaggatcggtcatctacatttcttgtcatgacagaagccaaagacccgtatggcacatttgtaaacgaatacaaaacaccccaagccatatatgttgcatatgcgtaaacgatcttcatcgttggtgataaaccggacggcattataaagataatgactgtcataatcgctagcaatacagaagaaaccatcataactggacgaaacttaccgcgctttccgggggttctcgaatcaatgatggatccggctaatgggtccataaatgcatcaaagatttttgtaatcgaaaaaacaccggcggctgccgcagcgctaatgcctgcgacatccgtatagaaattggtcaaataagattgccccaaatcaaacataaaaccattcccaaaatcaccaaaaccgtaactcactttttcttttaacgaaatacgcttggatgcatgctgcggatcaattatcttttccgcggtcgtttttacaacgctttcagccatgtttctgcaccacctatttttattaaaaagtgcgaaattttccaactctggaacaacataagcctttattactcaaaaaaaccaaaatatcgataagcattatggtaagcaatatcttcaatgattttcccgatctgttcttcatcctcggggatttgtccccgttctgcccattcgccaaatagctcgcatagtaccctgcggaaatattcgtggcgcgggtatgacaggaaactgcgtgaatcggttaacatgccgacaaaatttggcaggaggctttcttctgcaaacatttccaattgcctgcgcatcccgcttcttgtatcgttaaaccaccaggcgcatcccagctgcaatttctgaaccgtatctttttggaaacagcccatcattgtgacaagcgggagccagtcgttcgggtttaaagaataaagaatcgtttttggaatgatatcttcattttctgcacgggcaaataatttcccgtaagattctgcaatacatcgatcattcaatgcatcataccccgtatcaggccccagtttttcaaacatgggcccatttaagttcctgtaagcatgaatgtgatattgcatgacccagcctttttcgtgataaatgtgcataagttctattaacagcgctgtgtgatattgattgatttcatttaaactcaacgcttcttgtgataacgctttctcaacgatcgcatccaattgttgcggcgccgcctctgcatacgtaaaagtatccagggcatggtcggataaccgtccgcctctttcatggaaatattcaattcggtttcgaacagccgaaacgagatccgagaaattttggattgaaacgcctgaaacagttgctaatttgtggacataatcagcgtattctttattctggatgttcagcaccttatcgggccggaaagccggcagcaccttaaaaccattttccgtctcggattcctgtaacaatttatggtattgaaggtcatccaccgggtcatctgttgtgcaaaccactttcacattgctgtttttaattaaattccgtggtttaaaatcatctgtcgccagcaattgatttgcctgttcccaaatggccggtgccgttttgcggtttaaaatcgtatcaatttcaaagaaacgccgcaactccaaatgcgtccattcataaagtggattgcccactgatttttcaatcgtttccgcccattttaaaaacttttcgtaagggtcagcatcacccgtaatatatttttccgggacaccgtttgcgcgcattaaacgccatttataatggtcaccgtaatgcccttcattgatccacacttgtgccaaatctctgaaatttttattttcgtagatttccttcgggttcaggtggcaatggtaatcaataatcggcattttttcggcatggttgtgaaataatttcttggcaaaatctgttgttaaaagaaaatcttgatttaagaacatgttctataccttctttttggaatggaataatggtttattcagtaacgccgttcttaaatatcgcaatctcatgcagatggcggatctcatttttcgtcttcttcccgctcgcgacttcaagaataaaagaaataaattgttctactacttcgtccatttcttcatcaagcagccgtcccgcgttgaaatcaatccactgctttttcttttcataaagttcggtgttcgtcgatactttcacagttggcacaaaggttccaaacggtgtgcccctgccggttgtgaacaggaccatctggcaatccgccgctgcaagcgctgttgaggaaacaagatcatttccgggtgcctgaagtagggataaccctttttcctttagtttttctccgtattccagcacatcgaccactgccgatgtccccgctttttgcgtgcagccgagcgatttgtcttccaaagtggtgatcccgccggccttattgcccggagaaggattttcatagattggctgcccgtaagaagcaaaataatctttaaattgattaatgagcttcacaattttattgaatacgatttcatcttttgctcgtgccattaacattttttcggcaccgaacatttccgggacttccgttaaaacagtggagccgccttgagaaatgacaaaatctgaaaatcttccaagcagtggattgccggtaatgcccgaaaatccgtctgagccgccgcattttaatccaattttcaattctgatagaggcagatcgatccgcttgtcctcttttgcagcttcattcaattcttccagtagttggaagcctgtttccacttcatcttcaacatcctggcaaatcataaactttacgcgcttttcatcaaactctcccatttgtgccttcatttcatctagctggttgttttcacagccaagcccgaagatgagcacaccgccggcatttggatgggcggccgcatccattaaaatcttgcgggtgttctgcaaatcatcccccagctgggaacagccgtatggatgtttaaacaatataatttcatcaaatgcgccgttatcagggtgattcgccttaaattggtcaacgaggagatcaccgatcatattgatgcacccaacagtcggaatgatgtataaatcattgcgtatcccggcttttccgtttttccgcaaataacctttaaaagtgcggctgtctttcggaaagatgcggggatgcagttccggcttgtactcgtattccacttttccggaaagattggtgctcacgttatgggtatggacccagctgccttgttcaatcttttttgtcgcatgtccaatgggtgacccgtattttataatgtccgcgttctcctcgatatcttctaaagcaattttgtgtcctctttttattgcctcatttacggtgatcgccctagcccctgatgtaaggacatcacccggctctaaatcctgaagagcaacgagtacattatcccgggggtttagctgaatggttttatttttcaatcggtaatgcctcctcgttggcctgctgcactgccctgcgaacgccctctttttctatcaactgtaagcctttttcaacttgagcgggcaggccgtcaatttttgtcaaatccattccccataaggtttcgttgcttaaaatgtcccaaacatagcgatcggagtgatacgccattgaaaactctttcaaaacatccggcaaatcaattgctttagcagaggcaggatcctgctctccataaattttcaacagcccggataaagctaacgcaattcttgacgggattttgtggaacctttttacatgctccgccaatatgggaaggaggcgtgccttaaattttgaaacgctgtttaaagcaatcgcgtccagctggtgttccatatacgggtttctgaaacgttcctgaatttccgccgcgtaacttgtcaactcttcttttggcaaatccaatgacgggatgatttccgcaaacatttcgcggtcaatcaaccggtaaaaatcgggatcttccattaccccgccgacagttttaatgccggcaagtcgcgccaagcaggccattgttgtatggggggcgtttagtaagtatactttccggtcgcggtacggttttaaatgctcggtaaccacgacattcagccccgcttttttgagcggcagttcttcttcaatctccttgggcccttcaatcacccaaatgagaaatggttctgcttttgcaattaacgtatcttcatagccccattcttcccaaaatttttctgcgcggtctttcgggtagcccgggacaatccggtcgaccaagctggaacagaaagtattttctgtttcaagccagctgctgaaatcttcgccaagctgccacttatccgcatagcggtgcacaatttctttcagtgccttgccgttattttcaatgagctcgcaaggaatgatgtaaaaccccttttttccggccttatatctttcatagagcagtgccgtcagttttgccgggaaacttacggggggccggtcggataatgcatctccttcatgatagacgatgccggcttccgtcgtattggaaaaaataaaccggatgttgtcatcatgagccaattgtaaataggcgtcataatcttcataaggattgatcccgttatttaccgatgaaataatctcatgggactggactgcttttccattttgcattccttccagcatgactgtaaataaatagtcctgtccagcaagttgccctactcttccgcgtggcattgattgtacaattgtcaccccaccttgaaaaagtccacgtttgttcatttgctgaatctgccagtcgacaaaagcccgaagaaaatttccttctccaaactgaatggcttttgttggatagcgttgcaggtctttcacgtatgaataagataattttttcaaattcttccctcctttatttcctatttggaaataaagtttcttatttgttcttacattccttattataatccgctttcaaatttattcaatagtttttttgctttttttgaacatttgtttatcgaacgacttcccggccggaagcgccttcccatgatcggacttcgtctgctgaaagcggcagggcatccccgttcacggaatgtttcaaaacagatgtagcagccgcaaattgtacggtttcttccggatccatcccggttaagaagccgtgaagcatcccggctgcataggcatccccgccgccgatccggtctacgatctgctccatacggtaacgcttggattgtataaaaacgccgccagtccagagcatgccctgcaattcatggcaggtcggggagatgacgttccggtctgtcgcatagagtgcgcggagattcgggtacttgcggctgatttcccggtaacatgcttccatattgccgggcacagccaccgatgcatcaatgccaaaaaagtttcgggcatcaagatagttggcacagcagtaagtgagcatcggcaagatcgggataatggctgccctcgcctcttccatcgtccacattgccggccggtaattgatgtcgtagctgaccggaatgccgcgatcaaaagccgctttaacgagaatttgcccataatatttccatgattcggacacagcaaaggtaatgccagtcaggtggaaaagggccacatccgcaaaaagccggtcaaaatcccactcgccaatatccatctgtgaaaagctggaactttccctgtcatagatcactttggaattgcgcaatgtgcccccctgttccaaaaaatagatgccgagccggttgccgcccattagaagacgggaagtatcaataccgcttgcccggaggcttctcactgcagccgctcccaaaggggaatccggcactttgctcgcaaacgcaacgtcatgcccgaaactggcaagcgttgtggcaacattcgcctccgccccgccgtagtttacattgaaagaatggctgcaggataaaagatctcccggggaggtggaaaggcgcagcaaaatctctccaagtgttaaaattttaggcatattgacccctcgattgctgatgcacggcttctgttagttgctgatatttgtccacaaacgctcttgctgtctcggtcactttcgcaaaatcattggtttcggcaggtttcaataagcttccgcctacgccaaggattttacagcctgctttgatccaatttcccatattgtccagactgattccgcctgaaggcatgatttcaagttgcggcagcggagcttttacgtcttttacaaatgccggcccgacaatattgctcgggaacagtttaatcacttctgcccctgcctgcatggccgctttcatttcatttaccgtcatacagcccgggatataagggatttgataaaggttacaaaaagcagccgtttccggatcaaatgtcggcgcgacgatgaattttgccccggccatttgcgcggtctgggcggtctgggcatccaggacagtgccagctccaacgaggacatcatcacggtcttggtacagttccgtcaattttttgatggcaacatccgcattcggaacggtaaaagttagttcgatgcttttgatcccgccggcaatcagtgcatccgtaatacgcaaagctttttcaacggagtctgcacgcagcacggccacaattccatttttttctaacgcctgcaaagtctgcatttttttcatggtgcacgctccttttaatttctatataataaactttatttatgaataataaattcaatttcattttacaacacactctctcctatgtaaaccatttcatgaaagagaaaataaaaaacttgccccgtgtcggaacaagttttttccattagccattcaatttgctttcaattttttgtcgtgcctctaagatgcttgtaatcattttttgcttcttttcttctgtgatccggaaccgcggggcactaacgctcatcatcccttcgatctttccgttccgcttgatgaccaccgcaatacagtaaatgtctttttcattctcttggttgtcaattgcatacccacgctgtttgacttcctggagatcttgaatcagtttttccgggtccgtaatcgtgttttcagtccttttttcaatcgtaatccgggacaaataatcacgcacatctttctcgctctgttcagccaagtacgcttttcccatcgcagaacaatacagcggcagcgtatgcccgacctgcgagcttaaaatgatttgcccttttccgttcagctttttcacgtacaccacatgatcctgttcataaataccaaggtggacggtttcgccaatggtgtcattcagttcttcgagcaccgcttccgccacgtttacaatattaaaagatttgcgggcggtttccccgtaacggataagcgcggtaccgagcgtatatttctttgtctcttcatcccgttttacaaaatcaatcgagcaaagggtatttaaaatttttaagaccgtggatttgctcgtatttaaagccgtgcaaatttcctgcagactcaccgggtccacccggtattccagatagtccagtatatctttcgcacggatcaacaccgtgccgtacggttttttttccgttgtcgtctccatctttttatgctcccgtctttttgaagtagccaaataagaaactttgaataccctctttataacataatttaaaaaggttgtaaaacgggacgtgatggatttccagaagaggaaatgatggataagaatcgtgaagttgtccgaagtattggacaaacgtatgatgcgcatcatatcattgagaataactttgatggccctcatgcgtggtggaatatggaatattcatcttgcaaaatatccgaatgaaaccaagctggcatacatggaaagggagtgccgtcagaaaaactgttttcaaggaggtaaaaggtcaaattggctaattttgaatttatgaataggtacaagcataaaatttataatgtaacggaaaatgatattttaatcgctgagcagagaatgaacctaagttttccaagcgatttaaaacaattttatttagggtttgctgaacgaatgagattctgtcagatacaagccaaattacggttaaaaaaatataaaatagtgttgtgtaaacagaaggccagctgaatcagctggcctttttgaatgtgtaaataagggagatataaaaatttccataagaaaaacgacaaagatttaccttttgaatctgattatattactaacctgataataattttttaaaaattttaaaaatatattgacggcggtaataaaattgtgcataattagggcttgctgaataagcaaaattcctagatttggcaaggatgctaacaggttcggaaaaaattaaatgcaaggattttataaaatgttaaaactaagaaaggctggagtgttaaaaaatgattaataaaaataccgaagaaaaagatatattgttgaatgttttaggtataatcgaggctgtatataataagaaaatttcgatagaagaagctgagaaaagatattttaattaccgtatcattgattctttgaaggaaaaaaattactcaaatgaattaatagaaattttggaactgggtacagaaattgatggtattaatgatttactacctgacaagttagatgaaaacataattgatttaaaaaatagagttcttcttttgttagatagagaaataaaagcataaaaatagtccccgcagacgcgagggctttttgatttgtcctgccgtagcagtaaaagcttttcaaagggctcgacctcctatgaacccgcacccccaatctgtctgggttaatctttaccgctcgctgcgcacgcagtcccatcgggtggtccgtgaacatccggttgtctccccaaacagaaatgctgaaaaaggggcagttttcctagttgcattttctgtagggaatcatgtataattaaagtcaaatatagtcaaagtcaaaagacggtgtcaggaggtggctttgatgaaaaatatatcggatatcatagaggaatatttaaaacggattctggaactgaatgaaaaagaaattcttgaaataaaacgcaatgagattgccgataagttccaatgtgtcccttcgcaaatcaattatgtcatcaatacgcggtttacgattgaaagagggtatattgttgaaagtaaaaggggcggcggcggctatatccggatcatgaaagtgcggcctgaaagcgatgcggaactgattgaccagctgcttgtgcatatcggcaatgtcatctcccagtcgaatgcggaagccatcattctccgcctcgttgaagaagaggtgatttcaaggcgggaggcaaaaatcatgctcagcgtgatggaccgctccgtgctctacatccagttgccggaacgggatgaactgcgtgccagaatgttgaaatcgatgttaacgaccttaaaatacaagtaacaatagaggtgagtatgccgtgatttgccaggaatgcaatgaaaggccggcaacgatgcattttactaaaattataaacggtgtgaaaacggaattccatctttgcgagaagtgcgcgcaggagaagggggaaaagttttcatcggattgggggaaaaccttttccttcgataatctgctcgcgggcctttttaattttgatccggccatccaacttttcaaacaggaaacagcacctgacccggatgtgcttcgctgcaaccattgcgggatgacattgaaccagtttttaaacacaagccggttaggctgcccgcattgctatgagacgtttcagcaccagcttgttccgattttgcagcgccttcatggcggcaacgttgcgcatgaaggaaaaatacctgcacggattggcggtgccatttatacaaagaaaaaattgcaggaattaaaggcggcgttgcaggaagccatcagccaggaagaatttgaaaaagcagcagaactccgcgatcaaattcgcgcacttgaaggttcttctcaagcaaaaggaggggaacaataatgtctttagaacattttttgcacaaagcgtccagctcctggatgaacgagcaagggcctgaatcggaaattgtgctgacgacacgggttcgtctggcaagaaatttaaaaaattaccggttcccgtccttgtttaccagcgaggaagcaagggaaattatgaaaacaatccaggatatcgcccgaaatcattttccggctgaaatgcaggctgaatttttaaaaatggacgaattaaaaccgctcgaaaaaagggtgcttgtggagaaacacctgattagcccgcaacttgccgaagaagcgggtgacggggcagttattttgtcaagcggcgaagatattagtattatgataaatgaggaagatcatttacgcatacaatgtctttctccagggcttcaattgcatgaaacgcttcagaaagccaatcagcttgatgacctgcttgaaaattgggtcgattatgcttttgatgaaacgctcggttacttaaccagctgcccgacaaatgtcggaacgggcatccgcgcatcggccatgatgcatttgccgggacttgtgctgacacagcaaattaaacaaatcattccggcgattcatcagcttggtttggtggtaagaggaatatatggcgaaggaagcgaagccatcggaaatatttttcaaatttccaaccaggtgacactcggaacatcggaagacaatattgtctcggatttaaccagtgtcatccggcagatcattacacaggaaagatcggcaagggaagcattggtgcagacttcaaacatacaattagaagacagggtttaccgttcgctcggtgtcctgcaaaacagcaggatcattgaaacaaaagaagcggcccgttgtttgtccgatgtccggctgggaattgatctgggctatattcaaaacatttcgaaacaaattttaaatgaattgatgattttaatgcagccgggatttttacagctttatgccggaagagcgctcagcccgtatgaaagggatatccggagggctacactgataagagaacgtttgaggcttgaggagaccaaatgaacaggaggaatgacagatgatgtttggaagatttacagagagagcccagaaagtgctggccctttcccaggaagaagcaatccgcctgaaacataacaatatcggaacggaacatattttgctcggacttgtccgcgaaggggaaggcatcgcggcaaaagcgctgtacggcctgggtttaagcgccgaaaaaatccaggaagaagtggaaaccctgatcgggaacggccaggaaatttcccaaacgatccactacacgccaagggccaaaaaagtgattgaactgtcaatggatgaagcgagaaaactcgggcactcctatgttggaacggaacatatcctcctcgggctgatccgtgaaggtgaaggcgtggcggcacgcgtgctgacaaatctcggcgttagcttaaataaagcaaggcaacaggtgctccaattattgggcaacagtgaagcgtccgtacagggcggttcggcggccagcgtcagcacaccgacactggacagtctggcccgcgatttaacagcgatcgcacgggaagattcccttgatcctgtaatcgggcgcagcaaagaaattcaacgcgtcattgaagtactgagccggaggacaaaaaacaaccctgtccttatcggggaaccgggcgttgggaaaacggccattgcagaaggccttgcccagcaaattgtgcataatgaagtgccggaaacgctgcgtgacaaacgggttatgacgcttgatatgggtacggttgtggccggtacaaaataccgtggcgaatttgaagaccgcctgaaaaaagtcatggatgaaatccgccaggccggtaatatcattcttttcatcgatgaattgcataccttaattggggccggcggtgcggaaggagccattgatgcttccaatattttaaaaccgtcgcttgcccgcggcgaactgcagtgcatcggggcaacaacactggatgaataccggaaatatattgaaaaagatgctgcactggaaagaaggttccagccgatccaggtcgatgagccgacgattgatgagtcgatccagattttaaaagggctgcgcgatcgctatgaagcacaccatcgcgtctcgattaccgatgaggcgatcgaagccgctgtaaaactttcggaccgctatatcgcagaccggttcctgccggataaagcgattgacttaatcgatgaagccggatcgaaagtgcgtcttcgttcctttacaacgccgccgaatttgaaagaactggaattgaaactggaagaggtacgcaaggaaaaagatgcggccgtccagagccaggaatttgaaaaagcggctgcgttaagggataccgaacagaaactgcgcgaacagctggaggaaacgaagaaaaactggaaggcaaaacaaggacaggaaaacagtgaagtcacagtcgatgatattgcgcttgttgtttcgagctggacgggagttccggtgacgaaactggcacaaaccgaaacggaaaggcttctgcaccttgaagagatccttcactcccgggtgatcgggcaggaagaagcggtacttgcagtggcgaaagcagtccgccgtgcacgggcaggattaaaagatccgaaacgcccgatcggttccttcattttcctcgggccaacaggggtcggaaaaacagaactggcgcgggcgcttgcggaagcgatgttcggcgatgaggatgccatgatccggatcgacatgtccgaatacatggagaaacattcgacttcccgcctcgtaggttcgccgcctggatatgtcggttttgaagaaggcgggcagctgacggaaaaggtacggagaaaaccgtattcggttgtgctgcttgatgaaattgaaaaagcgcacccggatgtgttcaacattttgctccaggtactggatgacggccggctgaccgattccaagggccgcacggttgattttagcaatacgattgtcatcatgacatcgaatgtcggcgcagatgctttaaaacgcaacaagagcgtcgggttcaccattcaggataccgtcgaggccgattataaagacatgaaggacaaagtgctcgaggaactgaaaaaagcgttccggcctgagtttttgaaccgtgttgatgaaaccattgtgttccattcgctcgagaagaaacagttgaacgaaattgtcacgttgatggcgaaagaattgtcggaccggttaaaagagcatcatatcgaacttgtgctgacggatgccgcaaaagaaaaagtggcggaaaaaggctacgatccggaatacggcgcgcggccgctgcgcagatcgattcagaaaaacatcgaagaccgcctttcggaagaaatgctgaaaggcaatataaaagaagggcaaaaggtattggtcgatgtaaaagacggcgaatttacttttgccagtgtggcagagtcggaagctgtatcgtccaattcttaatgccgaaagcaggaaagggtacaatggttttggcgattgtaccctttttttcacatatataaaatttcgcgccaaaatcaatggcgattaggataacattgcttctggcaacacataaagaaggagtactgtttcgttcaacctatgtggcggtttcttatacgattttaattcaatttcaagatactttgtatacacttatacacatagatatgagggaaaggggtttaagatggcaaaaaaaaccgtaaagtttgtttgccagaactgcggctacgagtcgccaaaatggatgggaaagtgcccgcaatgcagccagtggaaccagatggtggaggaagcggagacgccaaaacggaggggcttttttttacatccggagcctggaaatgaaaccaaagcggcacctattacgtctatagagtctaaagaagaaaaaaggacaaaggtggattttggagagctgaaccgtgtcctcggcggcggcattgttgccggatcacttgttttgatcggcggggatcccgggatcggcaaatcaacgctgcttttgcaagtgtcatcacaactggcaaagcacgggttaaatgtactgtatatttccggggaggaatcggcgaaacagacgaagttaagggcggatcggttaaacatccataccgaccatctttatgtgctgccggaaacggacctttccgtgatccagcaggcgatagatgaactgaatcccggctttgttgtcattgattccatccagacgatttaccatccggaaatccagtctgcgccgggcagtgtgtcgcaagtgagggaaacgactgcacagctgatgcggacggcaaaaacaaaaaacgtggccatcttcattgtcggccacgtgacaaaagaaggctccattgccggtccgcgcgtgcttgaacatatggtggatacggtcctgtattttgaaggtgaacgccataacgcctaccggatattaagggcggtcaaaaaccgctttggttcgacgaatgaaattgcgattttggaaatgaaagaatccggtttggaagaagtccagaacccttccgaaatttttctggaagaacggacaaaaggtgcagccggttctaccgtggtggcttccattgaggggacgcgcccggtccttgtcgagatccaggcgctgttggccccgacgtttttcaatatgccgcggcggatggcatccgggattgactataaccgtgtcacgctgattatggcggtgcttgaaaaacgggccggtcttttgattcagaaccaggatgcttatttaaaagtcgccggcggcctgaaagtggatgaaccggcagtggatttggcagttgctgtcagcgtggcatccagttttcgcgacaagccgacaaatgcggatgactgcattatcggagaggtcgggctgacgggggaagtcaggcgggtgtccaggattgagcagcgcgtccaggaagcggcaaaacttggtttccggcgggcgatcatcccgaaaaataatatgggcgggtggacgccgccaaaagagattcaagtgatcggcgtctccacaatccaggaagctttgcaagcggcactcggcggatgagaaagggaacaaatttccgtgccttctatgtgttctttggatcagtgcgtgagggtaccggaggaagcggaaggcactgggaagtgaaggaaagcgtggaaaaaaacggaacccacttgataagcaaataactgccgcaaatctgcgtttacaggatccgttatgatgtaaagacagaaaagacagcggctggcaggatacaaattttaaaagaaagcaggggatgtgcatgaagcctgaaaatgcccggagaaaaccgcggcgattaactggctcggtagggaaaaatacgaaggcaaacgttttaaaccctattttttgtttataatgtataaaggaggtgaacatgttgttaagacggcttatacaaatttgtttggtactgattggcggcacgctcggtgttttcctgctgcctgatttttacaagcttgtgaaagtggattatgtgttaatcaacaacccgtatgtttcagcgctgttgggggctattatcttttatcttattactttctggtccattcattatatcgttgattttgtcgattggtttgaggattcactggtaaaagtcccgatgacggaaattttttccggcacctttggccttgtgctcggcctgattattgcttatctggcaagcattccggtgcggggaattccgattgtcaatacaattgtgtcgattacacttacagtattgctcggttatatcggatttcaggtcggttttaagaaaagagaggaaattttcaatttgtttttcaaccggcagcatagacggaaaggcgggacagagcaagaagggcatccgcagcctggaaaacaggtgaagattcttgatacaagcgttgtcatcgacggacggattgcggatatttgccagaccggttttcttgacgggccgattgtgattccgctctttgtgcttgaagaattgcagcatattgccgattcttcggatgctttgaaaagaaaccggggccggcgtgggcttgatatcttgaaccggatacagaatgaactgccgatcgaagtgcaaatgtatgaaggcgattttgaagatatccaggaagttgacagcaagctcattaaactggcaaaattgatgaacgggattgtcgtgacgaatgattataatttaaataaagtatgtgaattccagaaagtcaaggtgctcaatatcaatgaccttgccaacgccgtaaaaccggttgtgctccccggcgaagagctcaatgtgcaactcattaaagacgggaaagagcatcaccaggggattgcctatttggatgacggcacgatgattgttgtcgaagaaggcaaaaattacattggcaaacgcattgatgtgctcgtgacaagcgtcctgcagacttcggcgggccggatgatttttgccaagccgaaactgcttgaaaaagcgttataatgcagcctggaacacccgcggcgccggacgcgggaagttcatacaggatgccgggggagattggatttgacagattatgaggtgattataccggcagccggatcggggaagcggatgggcgcagggttcaacaaattatttcttgaactgaacaagcgcccggtcattgcggttacagcagaagtttttttggccgatccgtcctgcaaaaagttgatacttcccgtgcagccgcatgatagggaagagatgaagcgtattttgccccgctcggaaaaaatagtatttgcccgcggcggttctgaacggcaatatagcgtacggaacgggctggaacttgccggaagctgcagtgtcattcttgtgcatgacggtgcaaggccgtttatcagcgccggatccattgcagcgctggcggcaatggccggggaaaaaggggcggcgatagcggctgttccggtaaaagacacgatcaaaagagcaaaagaccagattgtaaccgagacgattgagcggagcagcttgtggcagatccaaacgccacaagcttttcgcacgtctgtcttgaaaaaagcgcatgaagcggcggaacgggacggctttctcggaacggatgaagcctcactggtcgaacggatcggccatcctgtacatattgtgccgggaagttatgataatattaaaattacgacaccggaagatctttatttcgcagaagcgattttaaaaaagcaggggggaggatgaagatgttcaggatcggacaaggctttgacgtgcaccggttcggggagggacgtcccttgatgatcgggggagttgaaattccatatgaaaaaggtttgctcggccactccgacgcggatgtgttgcttcatgccgtagcggatgcctgtctcggggccattggggaaggggatatcggccggcattttccggatacagatgcggcatttaaagatgcggattctgcggcgcttttggcgcatgtttttcagcttgtgaaacaaaaaggatacaagctcggcaatcttgattgcacgattattgcccaaaagccgaaaatggcgccctatatcgggaaaatgcgggaaacgatcgcgcgcattttggaagcggagatcgggcaggtcaatgtcaaggcgaccacgacggaaaaactcggctttgccgggcgcgaagagggcattgcggcgcaggcggcggtactgctggagcaggcttaaccggcgtggctgcaagggtgctgaaacaacgggcagtttaaggcacgtactgcctgctggacattttaacggtgtatggcaacagaagtttcgtcaaaaatggtgcaacggagccgggcagctgttaacggaaacctttcttttgctggaacaaacataaccggtgtatcgctgcaaaatcgggacaagccgtgcggtttaggacccgcactgctgctggaaccattttaaccggtgtatggcctggagatgttttgccgaaaatggtgtaatggagcagtgcgcccggttatcggaaacccgtcttttgctggaacaagcatagcctggcgggggcactcgtggtacagtggcaattccattatcccgtcttttgctggaacaagcataatagcagatattttacctgcaagatgtgcgatggcatccatccgccggttcacgtcaatccatctttcgtccgccgaaccggacacaccaccggtttacggctttttcagacggtgatacaataaaacaagacaaaaagcgacagtttaaaggagaatcgacatggcaaacgaaatcagagtacggtacgctccgagcccgaccggttttttgcatatcgggaatgcccgtaccgcattattcaattatttatttgcacgcagcaagggtggaaagttcattatccggattgaagatactgaccagaagcggaatgtggaaggcggtgtggaaagccagctgaaatatttgaaatggctcggcatcgactgggacgaaagcattgatgtcggcggcgaatacggcccttaccgccagtcggaacgccttgatatctataaaaaatattatgaagacctgcttgaccgtgggctggcttataaatgctattgtacggaagaagaactggaagcagaacgcgaagcccagcttgcacgcggggaaatgccgcgttattccgggaaatgccgccatctgacagaagaagacaggaaacggcttgaagcggaagggcggaaaccgagcctccgtttccatgttccggaaggcaaagtgtatacgttcaacgatatcgtaaaaggcgaagtgtcttttgaatcggacgggatcggcgactttgtcatcgttaaaaaagacggcatgccgacttacaattttgcggttacgatcgatgatcatttaatgaaaatttcccacgtgctccggggggacgaccatatttccaacacgccgaaacagctgatgatttatgaagcattcgggtttgaaccgccggtattcggccatatgacgctgattgtcaatgaacaccggaaaaaattgagcaaacgcgacggtagcattatccagtttattgagcagtatgcggaactcggttatttgccggaagcactatttaattttattgccatgctcggctggtcaccgaagggcgaggaagaaattttttcgcgggaagaatttatccaaatttttgacccggaacggctgtcgaaatcgcctgctttgtttgaccgccaaaaactggcatggatgaacaaccagtatatgaaaaagctcgatttggataaagttgtggagctttcgttgccgcatcttgtaaaagcagggctcgttccggaaaaccggacacctgaagaagaacaatgggtgcgcaaactcatctctctctatcaggaacaaatgagctacggcgcggaaattgtcgaattgtcgaaaccgctcttctttacggatgaaatcacgtatgacgaagaagcaaaggagattttgtcgggagagcacgttccggaagtgctccgtgcattccttgaagaactggacagaatcgaaccatttgaagcaggcgaaatcaaaaaagcgatcaaagcagtgcaaaaagcaaccggacaaaaggggaaaaagctgtttatgccgatccgtgttgccgttagcggccagacacacggcccggaactgcaaagcctgatcgaactgctcggcagggaaaaagtaaagaaacgccttgaaagaatcacgggttaacattttttcgaaaataggatatgatatggttaaaatagatgtatgaaaaagcgttgagaaggagaagtaggaagaggacgcttcaaagagagaaccatcgccggctgaaagtggtttaagcccctccttttctgaaatgcaccttcgagcctgtatctgaacgcgtttgccagtaggatgcagcggggccgcccgttaacagggaaagttgggcagcgggcaaggcctgccgccaaacagagtggaaccgcgcgatcaagaagcgtctctgtccgttgcagaggcgcttcttttttaaattgcaggtccgatgacaaatccggctgatggaaatgcaaagcggaagaaattttataaacggacggggaatgggaaaaaaacaagcgaaaggggagtagcacatgtttaagcggttgaaggaagacattgaagtggtttttgatcaggatccggcagcacggacgtattttgaagtgatcttgacttactccggtcttcatgccatctgggcacaccggattgcgcactttttttataaaaagaaaatgttttttatcgcccgggtgatttcgcagctcagccgcttctttaccggaattgaaatccaccccggtgcacaaatcggcaggcggtttttcatcgaccacggcatgggggttgtgatcggggaaacgtgcgaaatcggcgataacgtgacggtttaccaaggcgttacgctcggcggcaccgggaaggaaaagggcaagcgccatccgacaattaaagacaatgcgttaatcgcaagcggagcgaaagttttaggttcgattacgattggggaaaatgcaaaaataggggcaggttctgtcgtattaaaggatgtcccccccaattcgacagtggtcggcattcctggcagggtcgtcgtccaggacggcgtcaaaatcaaaaaagatttaaaacataatgagctgcctgaccctgttgcggaccgcctgaacagcatgcagcaggaaatcgatgctttgcggtcggaagtggaacaactgagaaaggaaggggcaagaatgtatgagcattcagatatataatacattaacaagaaagaaggagccgtttatcccgcttgaagaggggaaagtgaaaatgtatgtatgcggcccaactgtctataactatatccatatcggaaatgcacggccggcgatcgtgtttgacacggtccggcgctatttggagtttcggggttatgatgtaaactatgtgtcgaatttcaccgacgtggacgataaactcattaaagcagcaaaagaacgcggagaagaagtgccggctttaagcgaacggtttatcaagtcttattttgaagatattgatgcgctcggttgctgccatgcagacgcccatccgcgcgtgacggaaaatatggataccatcatcgcgtttattgaaaaattaattgaaaagggccatgcctatgaatcaggtggtgacgtttactaccggacgagaagttttccggactacggtaaattgtctcatcaatcgattgacgaattgaaatcgggtgcgagaattgaaataggggaaaagaaagaagacgcccttgattttgccctttggaaagcggcaaaagagggagaaatttcgtgggatagtccgtgggggaaaggccggccgggatggcatattgaatgctcagcaatggcgaagaaataccttggcgatacgatcgacatccacgcgggcgggcaggacctgacttttccacaccacgaaaatgaaatcgcccagtcagaagcgttaacagataaaccgtttgcccgttactggatgcataacggctatatcaatattgataacgagaaaatgtcgaagtcgctcggaaacattgtgcttgtccatgacatcatcgagcggcacgatccgcaagttttacgctttttcatgctgtcggtgcattaccgccatccgatcaactacagcgaggaactgcttgccaatgcgaaggcagggcttgaacggatcaaaacgtcgtaccaaaatgtaaagcaccggcttgaatccagtgcaaatctggcagaagatgatgaaaaatggctggaacaggtccgttcgctccatcgccagtttatcgaggcaatggatgatgatttcaatacggcaaacggtatttctgttttgttcgaactgtcgaagcaggccaattattacttgcggggaaaaaatacgacagaaactgttctccgggcatttatgaaagagtttgaaacgatttccggcgttctcggcctgaagctcgaggaagaagtgcttttggacgaagaaattgaagcgctgattgaaaaacggaatgaagcaagaaaggcacgcaatttccaactggctgacgaaatccgtgacaagttgaaaagcatgaatatcattcttgaagatacgcctcaaggggtgagatggagacgcttatgacggtcacccttgatccgaaacaactgaacagccttgcgcttgcttatatgggagatgcggtatatgaagaatatatccggcaccatgtccttttgcagggaaaaacgaagccgaaccgccttcaccgggaagcgatccgctttgtttccgcgaaggcgcaggctcaagttttaaaacagatgatgaacgaagatcttttaacggaagaagaaaccgctgttgtccggcgtggcagaaatgcaaaatcgggcacggttccgaaaaatacggatgtccagacataccggcacagcactgcatttgaagcgctgatcggctatcactatttatccggcagccgggagcggatggaggcgctgattgaaaaagcaataggcattgtcgaagaccagaaaggaggggcgcgctgatggaccaggaatacattgctggcaaaaacccggtgctggaagcgttaagagcgggccgggaaatcaacaaaatctgggttgcggaaggttcacaaaaaggcgccatgaagcaggtgatggagcttgcaagggaaagaaaagtgaccgtccaatttgtcccgaaaaaaaagattgaccaggtggctgacggggcgcatcagggtgtactggcgctcgttgccgcttaccggtatgcagaaacaggcgatatgttcaaacttgccaaagagcggaatgaacacccgtttatcctgatcctcgatgaattggaggatccgcataatctcggctcgattttacggacggctgatgcggtcggcgcacacggcgtcattatcccgaaaaggcgctcggtcgcattaacagcaacggtggcgaaagcttcaaccggcgcgattgaacatatcccggtggcgcgggtaacaaacctttcgcaaacgattgccggcttaaagcagcaagggctgtggattgcgggaaccgatgcttccgggacgaccgattaccggcaaatggatgccgatctgccgctatgtcttgtcatcggcagtgaagggaaggggatgagcaggatcgtaaaagaagcatgcgactttctgatccgccttccgatggcagggcatgtgacttcgctcaacgcgtccgttgctgccggcctgctcatgtatgaggtttacaggaagcgccatccgcttggtgaataaaatgaatattttgctggtggacggctataacatcattggcgcttggccggaactgcaaaaattgaaacaaaaagaccttggcgccgccagagaccggcttgttgagatcatggcggaataccaaggctatacggatgacaaagtcatcgtcgtttttgatgcttacggggtgaaaggcctggaaaaaaagtaccgctatcacaaagtggaagtcatttttacaaaagaaaatgaaacggcagatgaacgcattgaaaaaatggccattaaactgaacaacatccgcacgcagatttatgtggccacatctgatttcactgagcagtggcaaatattcggccaaggcgctttaagaatttcagcacgcgaactgttgaccaaagtggaaatgattgaacaaaagattaaaaagaatgtaaaatcaattcaagaggaaaagccggcaacaagaataccgttaagccaagaggtcatggaaattttcgaaaaattacgcaggggaaaacgatgagcggttgacgattgaaaattctgtactgtataatagcttttatcgaatgctcatggggggatacaggtgaacctgaacattgaggcagcatatgaagaaagatatggcacgatgcaggatgaagagttggttggacggatacacaacggcgaaagtgaagcgttggattacttgatccaaaaatacagaaattttgtcagggcaaaagcgcgttcttactttatcatcggggccgaccgtgaggatattatccaggaaggcatgatcgggctgtataaggccatccgcgactacagagaggacaagctcacgtctttcaaggcttttgctgaattatgcatcaaccggcaaatgattaccgcaattaagactgccacccgccaaaagcacataccgcttaattcttatatttccctggacaagccaatttatgatgaagaatctgaccgtacgttgatggatgtcatcaccggcgcgaaaatttccaatcctgaagaattgattttaatccgcgaaaaatatgtccatatagaagtgaaaatatccgaactgttgagcgatctggaaagaaaagtgctcgccctttacctggacgggcagtcctaccaggaaatttcagaagaattaaaccgtcatgtaaaatcaattgataacgctttacagcgcgtcaaaaagaagctggagcgcctgttggaaatgagggagatgacttactgagaaggtgttgtaagccgtttttccgccaggctgtttttcccgaatgcaagtgcaacattaaggcgtacaaaagcacgtctttaaatgcccggtattcaatgctttcgggaaaaacccggcacatcccttctcctgctactaattgacacaagctttctgccgtgttatgttgatttgtaggattttatgttttgatacgataccggcgcggaaccggcagcatccaacagattctcccggtttttcggggatctttacagcggcgggttccgttaacgccgtaagatcataagacagctggtgatgagatgcagaaaaaaatggtacttgcctgttcggtttgcggttcgcgcaattacacgactacaacgggcaacggaaaggctgaaagaatggaattaaagaagttttgcaagcactgcaacgaacacaccatccaccgcgggacaaaataacaacgaacatgagcttacttggaggtcttaaatacatgtccatcacaaatttttttcgtaatgttgcttccgaaatgcgaaaagtcagctggcctgggcgcaaagagctggtcaaatacacgattacagtccttgtaacagttgccttcctgacattgttctttattgtcatcgatctcggtatttccgcagtgatccggtgggctgaaaactcattgtaaaaggatcatttttcacttgaatatccaatgataaaacatggtataatgggagtatcataagcaacgactcaaacccggttagcgggttttttcatttgtccaaaaaatcaaaagaccaacagggagggacggacatcaagtcctattaaatggaaaaaaactggtatgttgtccatacgtattcaggctatgaaaataaagtcaaaaccaatttggaaaaacgtgtagaatcaatggggatgcaggataaaattttccgggtagtggtgccggaagaagaagaacttgaagtgaagaatgagaagaaaaaagtggtgaaacgaaaagttttcccgggctatgtcctggtggaaatggtgatgacggatgattcctggtatgtcgtccggaacacgccgggtgtcaccggttttgtcgggtcgtcgggaggcggttccaagccgacgccgcttttgcctgaagaaattaataccatcttgaaacggatgggcatggaagaaaaacgggccgatgtggactttgaaatcggcgagacggttacggtaaaagaagggccgtttgcaaactttgccggcaagattgtggaaatggaccgtgacaaaggcagggcaaaagtcatggtcaatatgttcggtcgggatacaccggtagagctcgtttttgaacaaattgataaaatataacgggataaaacttgaaatcgatatgctgagatgttaatatgttataagtcagtatgttctttgcggatggcccgctgaccgggatcccacaaagaacagacacaatgcaatcacatgatcttatgatacactcgtgacgcgggtcatgagatgaattggcttcggatatggcttgtctttttagcttgtccattgtccggctaaccgcaagaacttgcggggatagcctgcgaagataacgaagcatgtttcgttgtctgcaggaagctcgcggcttcagccgtgaggggttcaatcaaacagatgagtgggagggctcagccctgttaccacatcacggacttaaggaggtgtgtctcgtggctaaaaaagtagtaaaaattgttaaattgcagattcctgccggtaaagcaaaccctgcaccaccagttggtcctgcactgggccaggccggcgtcaatattatgggattttgtaaagaatttaacgctcgtactgcagatcaggcaggcttgattatacctgttgaaatcacggtgtttgaagaccgttcatttacattcatcacaaaaaccccgccagctgcagttttgctgaaaaaagcagccggcattgaatcaggttcaggtgagccgaaccgtacaaaagtggcaactgtgaagcgtgacaaggtgcgtgaaatcgcagaaacaaaaatgcctgacttaaatgcggcaagtgttgaagcggcaatgcgtatggtggaaggcacggcgcgcagcatggggattacgatcgaagactgattcatgcagtactagttctgtccaacggggttgcgatgcgatactggctcgcaacctttttcgtgggaggttattccgttaaaaccacattcgaggaggaaatacaaatggcgaaaaaaggaaaaaaatatgttgacgctttgaaactcgttgaccgttccaaagcttacccggttcaggaagccattgaactggtgaaaaaaacaagttttacaaaatttgatgcaaccgttgaagttgcattccgcctcggcgttgacccgaaaaaagcggaccagcaaatccgcggtgccgtcgtgcttccaaacggaacagggaaaacccagcgcgtgcttgtttttgcaaaaggcgaaaaagcaaaagaagcggaagcagccggtgcggattatgtcggcgatacagactacgtcaacaaaatccagcagggctggtttgattttgatgtcatcgtggcaacgccggatatgatgggcgaagttggtaaactcggacgcatccttgggccgagagggttaatgccgaacccgaaaaccggcacggtaacatttgatgtgaccaaagcggttcaggacattaaagccggtaaagtcgaatatcgtgttgacaaagcgggcaatgtccatgctccgatcgggaaagcctcttttgaaccggaaaagctggctgaaaacctgacgacattgtttgacacattgatgaaagcaaaaccatcagctgcaaaaggcacttacatgaagaatgtttctgtcacatcgaccatggggcctggcatcaaagtggacccgtcttcttttgcggtagcaaaataatcatttgacatgctgcatatcggctgatataatgaaaaacggctttgaaaagtaaacatttgtaccgtagacagcaggtgccgaagggcttaatttcctgccgaggtaatgcgtataaatccgggggtgccttaggccctccgcatgcatgaaacctccatgtctcgggatatggaggttttgttttggtataaatgttcatcaagaatatctgtaggaggtgtcaagatgggcagtgtaattgaacaaaagaaacaactggtggaagaaatcaccgataaattcaaatcaagtacagctgttgtggttgtcgattaccgcggcttaaacgtggctgaagtaactgaactgcgtaaacagctgcgcgaagcaggcgttgaattcaaagtgtacaaaaacacgatgacgcgccgtgctgtagaagcagccgggttggatggattaaacagcgtgatgaccggcccgaatgcgatcgcattcagtacggaagacgtggttgcacctgcgagaatcctgaatgatttcgcaaaagaccacgaagctttggaaatcaaagcgggtgtcattgaaggcaatgttgcaaccgttgatgaaatcaaagcactcgcaacgcttccttcacgcgaaggcctgctttccatgcttctcagcgtactgcaggcgccgatccgcaactttgctcttgctgcaaaagcagtcgcagatcaaaaagaagaacaaagcgcataagttttacgaaatatactttgaaaaaatatcttgtaggaggatatgaaaatgacgaaagaagaaatcatctctgctgtcaaagaaatgacagtgcttgaattgaacgatcttgtgaaagccattgaagaagaatttggcgtaaccgctgctgcaccggttgctgttgctggcggcgctgcaggcggggaagctgctgcagaaaaaacggaatttgatgttgtgctgactgaagtaggcgcacaaaaaatcaaagtcatcaaagttgtccgcgaaatcactggccttggccttaaagaagcaaaagaactcgttgacaatgctccaaaaccgcttaaagaaggcgtatcgaaagaagaagccgaagaacttaaagcgaaacttgaagaagttggagccggcgtagaagtgaagtaagaccctttttaaagtaaaagcccgcatttggcgggcttttttcaacatctcttcttcctgaatcctccaagaaagagtgggacttttcatggctgaacattactactcgcaaaaccctgaagcaaagcatcaaccgatagatttcacctttacattgagaggccatacctttcattttcaaacagaccaaggggttttttcaaaaaaagaagtcgacttcggctcccgcgttttgcttgatctggtgaccatgcctgaaacggaagggccggtccttgatatgggttgcggttacggaccgatcggccttgcgcttgcaacatcttttcccggccgccatgtgcatatggtggatattaatacaagagcggtcgagctggcggagaaaaatgctgcccggaaccatatttcaaatgtttccatatacgaaagcaatctttttgaaaaagtgaaaagcggcccgtttgccctgattgctacgaatcccccgatccgcgccggaaagcagatcgtgcaccggatttttgaagaaagctaccaatatctcgcaaaaaacggggaactttgggtggtcatccggaaaaagcagggcgccccttctgccaggaaaaaattagaaagcatatttgatgaagtggattgtgttggaaaagaaaaaggatattttgtttttaaagccaaaaaaatttgactcccgatttcatatatgttaaaatcataaaatgccaatagattaaggttctttatgcaatttaagctatatttgtcaagtatatattttggatgaattggaaaatacttataaaatcataagctcgtcatgcgatatgtggttttttcataaaaaaccctttttctttttgccttagctttattgttgtttgacgaaagatgcaaacaaaacgcttgatttgaggggtgaatcagttgtcacatcaactagttcagtatggacggcaccgccagcgcagaagttacgcgcgcatcaaagaaattttagagctgccaaaccttatcgaaattcaaaccgcatcttaccaatggttccttgacgaaggtttgcgtgaaatgttccaggacatctctccaatcgaggattttgccggaaacctgtcgctggagtttattgactacagcctcggcgaaccgaaatattccatcgacgaatgcaaagagcgcgatgtaacatacgctgctccgcttcgtgtaaaggtgcgccttgtcaataaggaaacaggtgaagtaaaagaccaggacgtgttcatgggcgatttcccgttaatgaccgaaacggggactttcatcattaatggcgcagaacgtgttattgtatcccagcttgtccgttcccctagtgtttattttaacagcaaaatggacaaaaacgggaaatacggctacaccgcaacggtcattccgaaccgcggcgcctggcttgaatatgaaacagatgcgaaagatgtggcctacgtccgcatcgaccgcacaagaaagctgccgatcacggttctcctcagggcgctcggtttcggctctgaccaggaaattattgatctgatcggtgataatgagtacttaagaaatacgcttgaaaaagataatactgaaagcacggaaaaagcgcttcttgaaatatatgaacgcctccgtccgggcgaacccccgaccgttgaaaatgcaaaaagcctgctgatttcgcgtttctttgatccaaaacgctatgatctggccaatgtcggtcgttacaaaatgaataaaaagcttcacctgaaattccggctgttcgggcaacggctggctgaatcaatcgcagaccctgaaaccggcgaaatcatcgcggaggaaggaaccgttttagaccggcgtacgcttgataaaattgtgccttttctcgaaaaaggcctgaagtttgaaacgtacagccagactggcggcgttgttgatgatgatgttactttgcagtccatcaaaatttatgccccgattgacgataacgaaaaagtcatcaatgtaatcggaaatgcttatgttgatgaaagcattaaacatattacacctgcggatattgtggcttccattagctacttctttaatttgctgcatggcgtcggcaatacggatgatatcgaccacctcggtaaccgccgtttacggtctgtcggcgaattgctgcaaaaccagttccgtatcggtctttcccggatggaacgcgttgttcgtgaaagaatgtcgatccaggacattaacaccattacgccgcagcagctgatcaatatccgtccggtcattgcggccattaaagaatttttcggcagttcgcagctgtcccagttcatggaccagacaaacccgcttgcggaactgacccataaacgccggctgtcggcactcggcccgggcggtttgacccgtgagcgcgccgggatggaagtgcgtgacgtgcactattcccactacggccgcatgtgcccgattgaaacgcctgaaggcccgaacatcggcttgattaactctttatcaacctatgcaaaagtgaaccgttttggctttattgaaacgccttaccgcagggttgatccggatacagggcgtgttacggagcatattgattatttaacggctgatgaagaagacaattatgtcgtcgcacaggcgaacgcacagctggatgaaaacggctttttcgttgacgatgaagtatatgcgcgtttccgcggtgaaaacattgttgtcaaaacagaccgcgttgattatatggacgtttcgccgaagcaggttgtatcggctgcaacggcatgtattccgttccttgaaaacgacgactcgaaccgtgccctgatgggtgcaaacatgcagcgccaggctgttccgcttatgaacccgcaagcgccgattgtcggcaccgggatggaatatgtcaatgcgaaggactccggcgcagcacttatctgcaaacatgacggtattgtcgaacatgtggaagccagggaaatctgggtgcgccgcgtcatcgatgtcgatggccaggaagtaaaaggcgaccttgacaaataccgcctgcaaaaattcaaacgttccaacaatggcatgtgcattaaccagcgcccgattgtgaaaaaaggcgaccgtgtggtaaaaggcgaaattttagcggatggccagtcaatggaccacggcgaacttgcccttggccagaacgtgctcgttgcttttatgacatgggaaggctataactatgaagatgccattattatgagcgaaaaacttgtaaaagaagatgtgtatacttctatccatattgaagaatacgaatctgaagcgcgcgatacaaaactcgggccggaagaaatgacccgtgacatcccgaacgtcggggaagatgctttgaaaaaccttgacgaacgtgggattgtccggatcggtgccgaagtaaaagacggcgatctgcttgtcggaaaagtcaccccgaaaggcgttacggaactgacagcggaagaacggctgctccacgcgattttcggtgaaaaagcgcgcgaagtcagggatacatcgcttcgcgttccgcacggcggcggcggcatcgtgctcgacgtcaaagtgtttacacgtgaagccggggatgaactcccgcctggcgtgaaccagcttgtccgcgtctatattgtacagaaacggaaaatccaccagggcgacaaaatggccgggcgccacgggaacaaaggggttatctcccggattcttccggaagaagatatgcctttcctcccggatggtacacctgtccagatcatgttgaacccgctcggcgtgccttcccggatgaatatcggccaggtgcttgaacttcaccttggcatggcggccaaaaaacttggcctccacgtggcgacgcctgtattcgacggcgcgcgcgaagaagatgtatgggaaacgattgaagaagccggcatggcacgcgatgcaaaaacggttctttatgacggccgcaccggtgagcctttcgacaaccgtgtgtctgtcgggattatgtatatgatcaagctcgcccacatggttgatgataaactgcatgcccgctcaacaggcccttactcgcttgtcacccagcagccgctcggcggtaaagcgcagttcggcggccaacggtttggcgaaatggaagtatgggcgcttgaagcctatggcgcagcctatacgctccaggaaatcctgaccgttaaatcggacgatgttgtcggacgtgtgaaaacttatgaagcgatcgtcaaaggggaaaacgtccctgaaccgggtgtcccggaatcgttcaaagtgctgattaaagaacttcaaagtttgggacttgacgtgaagattctttccggcgacgacgaggaaattgaaatgcgtgatctcgaagacgacgatgacctgaatcaggccgatacgctgaatattgcgcctgagacaaaagaagaaccggaaggaatcggggcatccaaagactaatcgtttatgttgctgggaacaaacagaggcttttgcccggattgtatgccttcgtacaatccggcttctgtttctgtttcttctgcgtgtgttttaaggtatgaacctaaagacgaaagggaggctggccccttgctggatgtaaataattttgagtacatgaaaatcggtcttgcttcaccggataaaatccgatcctggtcgtacggtgaagtcaaaaaaccggaaacaatcaactatcggacgttaaaacctgaaaaagacgggcttttttgtgaacggattttcggaccgacgaaagactgggaatgccattgcggaaaatataaacgcgtccgttacaaaggcgtggtttgtgaccgctgcggcgtggaagtaacaagatcaaaagtgcgccgggaaagaatgggacatattgaacttgccgcccctgtttcgcatatttggtacttcaaagggattccaagccgcatgggccttgtccttgacatgtccccgcgtgccctggaagaagtcatttacttcgcatcttacgttgtcacggaagcaggcgacacttctttggaaaagaaacagcttctttccgaaaaagaataccgtgcttaccgtgaaaaatacggcaataaattccaggcaggcatgggtgcggaagccattaaaaagttgctccaagatgtagatgtcaacaaagaatgcgaaatgctgaaagaagagctgaaagttgcccaggggcagcgccgtacacgcgccatcaaacgccttgaagtactggaagctttccgtaattccggcaataaaccggaatggatggtgctggacgttctcccggtcattccgcctgaactgcggccaatggtacaactggaaggcggccgctttgcgacatccgacttaaatgatctgtaccgccgtgtgatcaaccggaataaccgcctgaaacgcctgcttgatcttggcgcgccaagcatcattgtccaaaatgaaaaacggatgctgcaggaagccgttgatgctctgattgacaacggccgccgtggacgtccggtaaccggcccggggaaccgcccgttaaaatcgctttcccatatgctgaaagggaaacagggtcgtttccgtcaaaacctgctcgggaaacgggttgactattccggccgttccgttattgttgtcggcccgaacctgaaaatgtatcaatgcggcctgccgcgcgaaatggcgatcgaactgttcaagccgttcgtaatgaaagaactggttgaaaaaggcctcgcccataatattaaaagtgcaaaacggaaaattgaacgtttgcagcctgaaatttgggatgtccttgaagaagtcattaaagaacaccctgtcctgttgaaccgtgcgcctactttgcacaggctcgggatccaggcgtttgaaccgacgcttgtggaaggccgtgcgatccgtcttcatccgctcgtatgtacggcttacaacgcggactttgacggcgaccaaatggcggttcacgttccgttatccgccgaagcacaggcggaagcacgcatgctgatgcttgccgcacaaaatattttgaacccgaaagacgggaaaccggttgttaccccgtcccaggacatggtacttggcaactactacttaacgcttgaacgtgaagatgcagtcggtgaaggatctgtcttcaaagatgtaaacgaagtgtacacggcttattacaacggctacgtgcatttccatacgagaattgccatttatgccggatcgctgaacaatccgacgttcacggaagagcaaaacaagaagctgttgattaccacagtcgggaaagtgatcttcaatgaaattttgccggagagcttcccgtatattaatgaaccgacgacaacaaatcttgaagaaaaaacgccggataaatactttgttgatccttcgattgacgtaaaagcgcatattaaagaacagccgttaattcgcccgtttgtaaagggcttccttggcagcatcattgccgaggtgttcaaacggttcaagattacggaaacatccaagatgcttgaccgcttaaaagatcttggcttccattattcgaccaaagctggtattaccgttggtgttgcggatatcgtcgttttaggcgagaaagaaaaaattctttcggatgcccagaaaaaagtcgatacagtcatgaaacagttccgccgcggtttaattaccgaagacgaacgctatgaccgtgttatttcgatctggagcggggctaaagatacgatccagggcaaactgatggaatcgctcgataaacggaacccgatttttatgatgagtgactcgggggcccggggtaacgcgtcgaactttacacagcttgccggtatgcgcggtttgatggccaacccggccggccggattattgaattgccgattaaatcgagcttccgtgaaggcttaactgtgcaagagtactttatttcgacacacggtgcccgtaaaggccttgctgatacagcccttaagacggcagactcgggttatctgacacgccggcttgttgatgtggcgcaggatgttatcattcgtgaagacgactgtggcacagaccgcgggcttttgatcagtgcgttgaaagaaggaaatgaaatcattgaatcgcttgaagaacggttaaccggccgttattcaagaaaaacgatcaagcatcccgaaacaggcaaagtcatcattgaggaaaacggctttattactgaagatatcgcgaaagaaattgtcgatgccggctatgaaaaagtctggatccgttcggccttcacttgcaacacccgccatggtgtatgtaaaaaatgctacggccgcaaccttgccaccggccaagaagtggaagtcggcgaagcagtcgggattattgccgcccaatcgatcggcgaacctggtacacagctgacgatgcgtacattccatacaggcggtgttgccggggatgacattacacaaggtcttccgcgtattcaggaattgtttgaagctcggaacccgaaaggccaggctgttatttccgaagtggaaggtgttgtcacttccatcagcgaagggcgcgaccgtcaatatgaaattgtcattcagggcgctgtcgaaacacgcacttatacagccccttatacttcccgcttgaaagtggcggtagatgaccacgtcgtgcgcgggcaggaactgacggaaggttccattgacccgaaagacctgttgcgtgtcacggacgtcacaaccgtacaggaatacttgctccgtgaagtacagaaagtttaccggatgcaaggggtggaaattggcgacaaacatattgaagtgatggtccgccaaatgctgagaaaagtaagggtgctcgatgccggcgatacggatgtcctgccgggaacattgcttgatatccatcagttcggtgaagcgaatgaaaaggcgctcaaggaaggcaaccgccctgcaacaggccgtcctgttctgctcgggattacaaaagcttccctggaaaccgattcgttcttatcggcagcctccttccaggaaacgacccgcgtgttaaccgatgcggcgatcaaagggaaacgcgatgaactgctcggcttgaaagaaaacgtcattatcgggaaacttgttcctgcagggacgggcatgacccgctaccgcaaaacggttcctgaactggtgaaaaaggaagaagaagtgccggctgaataatcggcggcagcaccggcaaaaaccggtgctgcacctttttctgttttttagcaaaaaaccatggccttttttacacaggatgttgactttggattttcaaagtgataatatattcaaggtgctcctatgaatacctgtatactttggaggatattgcgatgtcttatgaaaaagtaaatcaggcgaaaagaattgttgtagggacaaaacaaacagcgaaagcgataaagtccggaaatgtggatgaactgctcgttgccagagatgctgatccgaatattacgggcaaagtcatttccgttgccgaacaattcaatgtgccggttacgtatgccgagtcgaaaaaacaacttggaaaagtgtgcggcattgaagtcggagctgcagctgttgcacttatttattaaacactttttgcgggagaaaccgcaaaaatttgtttttgccattaaatgaaccacctggatgtgtggacttaaattgttcgaagggaggaaaaacagatgcctactattaaccaattggtgcgcaaacctcgtaaatcaaaaatcgagaaatctaagtcacctgcgctgaataaaggctataacagtttcaaaaaaatcaataccgatctttcttcaccccaaaaacgcggtgtatgtacgcgtgttgggacgatgacgccgaagaaaccgaactcggcgcttcgtaaatatgcccgtgtccgtttaacaaacgggattgaagtaacggcttatatccctggtatcggccataacctgcaggaacacagcgttgttttaatccgcggtggacgtgtaaaagacctgcctggtgtacgttaccacatcgtgcgtggcgcgcttgacactgccggtgttgacaaccggaaacaaggccgttccaaatacgggacgaaaaaaccgaaagaaaagaaataataagaacgataaccatacttgaaaggaggatcatttatgccacgtaaaggacctgtcgcaaaacgcgacgtattaccggatccgatttacaattcgaaactggtcacacgtttaatcaacaaaatgatgatcgacggcaagagagggaaagcccagacgatcctgtattcttcctttgatattattcgtgaacgcactggcaaagatccaatggaagtttttgaccaggcattaaaaaacattatgcctgtacttgaagtaagagctcgccgtgtcggcggtgcaaactatcaggtgccggttgaggtgcgcccggaacgccggacaactttagggcttcgctggctggtcaattatgcccgcctccgcggagaaaaaacaatggaagaacgactggcgaacgaaatcatggatgcggccaacaatacaggcgctgccgtgaaaaaacgcgaagatacgcataaaatggcggaagcaaacagagcgttcgcgcattatcgctggtaatattccgatactcctacattacacctattaaggaaggagaaagtacgagatgccaagagagttctccttagaaaagactcgtaacatcggtatcatggcgcatatcgatgccggtaaaactacaacaaccgagcgcatcctttattataccggccgtattcataaaatcggcgaaacgcatgaaggtgcgtctcaaatggactggatggagcaggaacaggagcgcgggattacgattacttccgctgctactacagcacaatggaatgaccaccgcatcaacatcattgacaccccgggacacgtggactttaccgttgaagttgaacgctcccttcgtgtccttgacggtgcggttgctgtcctcgatgcccagtccggcgttgagcctcagaccgaaaccgtttggcgccaggcaacgacttacggtgtaccacggattgtattcgtcaataagatggataaaatcggggctgatttcttatattctgtcagcaccctgcatgatcgtctgcaggcaaatgcgcatccggtccaattgccgatcggtgccgaagacaactttgtagggatcattgaccttattgaaatgaacgctactttctacggtgatgatctcggcacgaaaattgaagtacgcgaaattccggatgagtaccgtgaccaggcggaagaatatcatgaaaaactgcttgaagcagttgctgaagttgatgaagatattatggaaaaatatcttggcggagaagagatttcaaaagaagaactgaaagctgcgatccgcaaagcaacctgtaatgttgaattcttcccggtactgtgcggctcggcatttaaaaacaaaggtgtccaattaatgttggatgcggttgttgactatttgcctgcgccgacggatgttccttccatcaaggggacgcttccggatacaggggaagaagtattcaggcattccagcgatgatgagccatttgcggctttggccttcaaagtcatgacagacccgttcgttggtaaactgacattcttccgtgtttattcaggtacattaagcgccggttcttatgtcaaaaactcgacaaaggacaaacgcgaacgcatcgggcgtattttgcagatgcacgcaaaccaccggaaagaaattgacaaggtttatgccggagatattgctgctgctgtcggtttaaaagacacgacaacaggcgacacgctttgcgacgataacaatccggtcatccttgaatcgatggaatttccagaaccggttatccagctgtcggttgaaccaaaatcgaaggccgaccaggataaaatgacgactgcgctgcaaaaactgcaggaagaagacccgactttccgtgcccatacggatccggaaacaggacaaacgatcatcgaaggaatgggtgagcttcacctcgatatcatcgtcgaccggatgaaacgcgaatttaaagtcgaagccaatatcggtgcgccacaagttgcatatcgtgaaacattccgcaaatcggcacaagtccaaggtaagttcgtacgccagtctggcggccgcgggcaatacggggatgtgtggattgaattttcaccaaacgaagaaggaaaaggctttgagtttgaaaatgcgattgtcggcggtgtcgttccgcgcgaatacattccggcgattcaatccggtcttgaagatgccatgcagcgcggtgtaattgccggttatccgctcgttgacattaaggcaaaactgtatgacggttcttaccacgatgttgactcgagtgaaatggcgtttaaagtggctgcttcccttgcattaaggaatgcagcatccaaatgtgatccggtcctgctcgaacctgtgatgaaagtggaaatcgtcattccggaagaatatctcggcgacatcatgggacaagttacagcccgccgcggtcgtgtagaaggaatggaagcacgcggaaatgcccaggttgtccgtgctatggttccattgtccgaaatgttcggttacgcaacagcacttcgttccagcacgcaaggacgcggtgtcttcactatgacatttgatcattatgaagaagtgccgaagtctattgcggaagagatcatcaaaaaaaataaaggcgaataattgatttcttgccttcaatgaagtataactttactagattggttcaaagcgctttaaagctgtcctttcagctttaaagcatccatatacttactcaatccaaaatattaaggaggatttcctgatggctaaacaaaaatttgaccgttctaaagaacactgtaacattggaacaatcggtcacgttgaccatggtaaaacgactttgactgctgcaattactgctgttcttgcaaaacaagggaaagcagaagcaagggcatatgaccaaattgacggtgctccggaagaacgcgaacgtggtattaccatcaacactgcacacgttgaatatgaaacggaaaaacgccactacgcacacgttgactgccctggacacgctgactatgtgaaaaacatgatcacgggtgctgcacaaatggacggtgcgattctggttgtatccgctgctgacggcccaatgccgcaaacacgtgaacacatccttttgtcccgccaagttggtgtgccttacatcgttgtattcctgaacaaatgcgacatggtggacgacgaagaattgcttgaacttgttgaaatggaagttcgtgaccttctttctgaatacgacttccctggcgatgaagtgccggttatcaaaggttctgctttgaaagctcttgaaggcgaccctgaatacgaagcaaaaatccttgaattgatggatgctgttgacgaatacatcccgactccgcaacgtgacacagacaaaccgttcatgatgccggttgaagacgtattctccatcaccggccgtggtacagttgcaaccggtcgtgtagaacgcggtcaattgaaagttggcgatgttgttgaaatcatcggtttgaacgacgaaccgaaacaaacaacggttaccggcgttgaaatgttccgcaaactgctcgactatgctgaagcaggcgacaacatcggtgcacttctccgcgggattgcacgtgaagaagtccaacgtggtcaagttttggcgaaaccgggttctattacaccgcatacaaaatttaaagcacaagtttacgtattaacgaaagaagaaggcggacgtcacactcctttcttctctaactaccgtccgcaattctacttccgtacaacggatgttaccggcattattacgctgcctgaaggcgttgaaatggttatgcctggtgataacgttgaaatgagcgttgaattgattgcccctatcgcgatcgaagaaggaacaaaattctcgatccgtgaaggcggccgtacagttggcgccggttctgtttccgctatcgaagcttaatcggttattaaaaaaagcccggccaggttatcccggccgggctttttccatgcttacgagtccgggttgcagcaatattttccaaaacttgatgttgcgccacaaggcctgtataataaaaaaagttgctgaaatcagcagtatatcaaagtttatgttgcattacacccggtttttgtgtataattttttatgttggtctttgactgcgatgaagtgggaggttgctggcacacccggccgctttgccatggcgcgtgggccaggaaaatttccatggagaatgtctattagcaaataggcgaaaaaggagggaaaataatggcaaaacaaaaaattcgcattcgattaaaagcatacgatcacagaattctggatcagtctgcagagaaaattgtagaaacagcaaaacgatcaggtgcaaacgtctccggaccgattccgcttccgactgagaaatctgtttacaccattctgcgtgctgtccacaagtacaaagattctcgtgaacaatttgaaatgcgtacacacaaacgtttgattgatatcgtaaatccaaccccgcaaacggttgattcactgatgcggttggatctgccatccggcgttgacattgaaattaaactttaatgataaaacatgacatatttaacaggaggtgtgactgatgaccaaaggaatcttaggaagaaaaatcggtatgacccaagtttttgccgagaacggcgatcttattcctgtcactgtaattgaagcaacaccaaacgttgtgctgcaaaagaaaacagttgaaacggacggctatgaagcgatccagctcggatttgccgacaaaccggaacgcctggcaaacaaaccggaaacagggcatgtttcgaaagccaatacggcacctaagcgcttcatccgcgaattcagcggcgtaaacacaagtgattttgaagttggtcaagaagtcaaagtagatatttttgcagaaggtgacattgtagatgttaccggtgttacaaaaggaaaaggattccaaggcgtcattaaacgccacggacaacaccgcggtcctatggctcacggttcgcgttaccaccgccgtcccggttcaatgggtccgattgcgccaaaccgcgtcttcaaacaaaaagcactccctggacgcatgggaggagaacgggttaccgttcaaaatctgcaaatcgtcaaagtggatgcagaacgcaatctgcttttgattaaaggtaacgttcctggtccgagaaaagctttggttacagttaaagcagctgtaaaagcaaaataattgtaaagaaaggaggaaacaggaatgccaaaagtagctctatacaaccaaaacggttcccaagtcggtgaagtggaattaaacgacgctgtattcggcatcgaaccgaatgaacatgttttatttgaagcgatcatcatgcagagggcatcgctccgccaaggtactcacaaagtaaaaggccgttctgaagtacgcggcggcggacgtaaaccatggcggcaaaaaggtacaggacgcgcacgccaaggatcgattcgtgccccgcaatggcgcggaggcggtacggttttcgggcctgttccacgcagctacagctacaaactgccgaaaaaagtacgccgtcttgcgattaaatccgctctatcgtcaaaagtacgggaaaacaatattttggttctggacgcattaaattttgatgcgccaaaaacaaaagattttattgctgtcctgaaaaatttgtccgtggataaaaaagcacttgttgtcacagacggattgaacgaaaatgtggtattgtctgcacgcaacattccgggtattacggttgttgaagcaacaggcgtaaatgttttggatgttgtaaaccatgatcaattgatcatgacaaaatccgctgttgaaaaagtaggggaggtgcttggttaatggatgcacgtgatgttttgaagcgccccgtgattactgaacgttcaatggaattgacggcagataagaaatatacatttgaagtagatgtcaaagcgaataaaacagaaatcaaagatgctgtggaagaaattttcggcgtcaaagttgcgaaagtgaatgttgcgaactacaaaggcaagttcaaacgcatgggccgttatactggctatactaacaagcgccgcaaagcagttgttacgctaacacctgacagcaatgaaattgaaatctttgaggtttaaatacgttccatcaaacttgaagaggagggaaaaacatggcgatcaaaaaatacaaaccaacctctaatgggcgtcgcggcatgacggctttggattttgcggagatcacgacggataagcctgaaaaatcactgcttgctccgctttcgaaaaaagcaggccgcaacaaccaggggaaattaactgttcgtcatcagggcggcggtcataagcgtcaataccggattatcgacttcaaacgcgataaagatggtataccagggcgcgttgccacaattgagtatgacccgaaccgctcatctaatattgctttgattcactatgcagatggtgaaaaacgatacattcttgcaccaaaaaatttaactgtcggcatggaaattatgtccggaccggatgcagatattaaagtcggaaatgcacttccgctttctgacattcctgttggtacggtcatccataatattgaattgaaaccgggcaaaggtggccaattgatccgttctgccggtacttctgcacaagtgcttggtaaagaaggcaaatatgtgcttgtccgcctgaattccggtgaagtgcgcatgattcttgcaacttgccgcgcaacggtcggccaggttggtaacgaacagcacgaactggtcaacatcggtaaagcaggccgcaaacgctggatgggtgtacgcccgactgtccgcggatctgttatgaacccgaacgatcacccgcacggcggtggtgaaggaaaagcaccaatcggacgcaaatcaccaatgtcaccatggggtaaaccgacacttggttacaaaacgcgcaagaagaagaatacttcagataaatttattgtacggcgccgtaaaaaataacgctgttgaactacggttcacagcttgaaccgtagctctaatcaggaaggaggactattcatgagtcgcagtctgaaaaaagggcctttcgttgacgatcacttaatggtgaaagtggaaaaattgaacgaatccaacaagaagcaagtgatcaaaacatggtcacgccgttcgacgattttccctgcatttgtcggccacacaatcgctgtctatgacggccgtaaacatgttccggtatacatcacggaagatatggtcggccataagctcggtgagtttgctccgacacgcacattcaaaggtcacgccggtgacgataagaagacaagacgctaacgggaggaggtattccaatgcaagcaaaagctgtcgcgaaaacagtccgtattgctcctcgtaaggcacgcctggtaattgatttaattcgaggaaagcaagtaggagaagcgctttcgattttgaaatttacgcctaaagctgcttcgccggttattgaaaaagtactcaactctgcgattgcgaacgcagaacacaactacgatatggacgcaaatgaccttgttgtggaaaaggcttatgtcgatgaagggcctacattgaaacgtttccggccgcgtgcaatgggacgcgcaagccagatcaacaaacgcacgagccatattacgattgtagtatcagatcaaaaggagggataattggtgggtcaaaaagtaaatcctatcggtttgcgaatcggagtgattcgtgactgggaatcgaaatggtacgcagaaaaagattacgccgatctattgcacgaagacattaaaattcgtgaatatatcgcaaagcgccttgcggatgcttctgtttctggcgtggaaattgaacgtgctgcaaaccgtgtcaacattacaatccgtacggcaaaaccgggcatggtgatcggtaaaggcggttcggaagtagaagcattgcgtaaagcgctgaatgctttaacaggaaaaagagtccacattaacattgtcgaagttaaaaaagcagatattgatgcaaaacttgttgcggaaaacattgcccgccagctggaaaaccgcgtttctttccgccgtgcgcagaagcaggcgattcaacgcgccatgcgtgccggtgcaaaaggaatccggacgcaggtttcaggacgtttgggcggtgcggatattgcccgtgcagaacattacagcgaaggtacagttccgcttcatacgcttcgtgcggatattgactatgcacatgctgaagcagatacaacttacggaaaactgggcgtaaaagtttggatttaccgtggggaaatccttcctgctaagaaaaaaaccgaggaagggggaaactgatcatgttgatgcctaaacgtgtaaaataccgccgtgaacaccgcggaaaaatgcgcggccgtgcaaaaggcggcactgaagttgcatttggcgaatatggtttgcaggctttggaagcttcctggattacaaaccgccaaatcgaagctgcccgtattgcgatgacacgttatatgaaacgtggcggtaaagtatggataaaaattttccctcataaaccatatacagcaaaaccgcttgaagtccggatgggttccggtaaaggtgcgcctgagggctgggtggctgttgtgaaaccgggcaagattttgtttgaaattgccggtgttcctgaagaagttgcacgcgaagctttacgccttgcgtcccacaagctgccgattaaatgcaagttcgtaaaacgtgaagaaattggtggtgaatctaatgaaagctaaagaaattcgtgacttaaccactgccgaaattgaacaaaaagtaaagtcgctgaaggaagagctgttcaaccttcgcttccagcttgcgactggacaattagagaacactgcccgcattcgtgaagttcgtaaatcgattgcccgcatgaaaaccgtcattcgtgaaagagaaattggaattaacaaccgataatgggaggaggttcgcgatacatgagtgaacgcaaccaacgcaaagtatacaccggccgtgtcgtatccgacaaaatggataaaaccgttactgttcttgtagaaacttacaaaaaacattctctgtacggcaaacgcgtaaaatactcgaaaaaattcaaggcacatgatgaaaataacgaagccaaagtcggcgatatcgtaagaatcatggaaacacgcccgttatctgctacaaaacgtttccgcctggtggaaatcgttgaaaaagcagtcattatctaatttgtatcagttcggatacggttgattccgaagggaggtaaacgaggatgatccaacaagaaacccgtttaaaagtagctgacaactcaggtgcacgtgaagttttaacgattaaagtattaggcggatccggccgaaaaactgcgaatatcggagatgtcatcgttgctacggtaaaacaagcaacacctggaggcgttgttaaaaaaggcgatgtggtgaaagctgttgtggtccgtacaaagagcggagtgcgccgcagcgatggttcttatatccgtttcgatgaaaatgcatgcgtcattatccgtgacgacaagagccctcgcggcacgcgtattttcgggccggttgcacgcgaactgcgcaacaacaatttcatgaaaatcgtatcactggctccggaagtactttaatcgatatagtttgtgacaatcaaggaggtgcgattgtaatgcatgtcaaaaaaggtgacaaggtaatggtgatctccggcaaagataaaggcaagaccgggacgatccttgcggtatatccgaaaaaaaaccgtgtgattgtggaaggcgtgaacgttgtcaaaaaacacgcaaaaccttcccaggcaaaccctcagggcggtattctcgacatggaagcgcccattcacgtgtcaaatgtgatgccgattgacccgaaaacaaatgagccgacacgtgtcggatatgaaataaggaacgacaaaaaagtgcgtgtagcaaaaaaatccggtgaagttctaagcgtgcttaaggaaattaagaaaaagcctgaagaagaagggaggtaagcgacatgaaccgcctaaaagaaaaatacgaaaaagaagttattcctgctttaacaagcaagtttcaatatacatccgttatgcaagtgcctaaagttgaaaagatcgtgatcaacatgggtgttggtgatgctgttcaaaacgcaaaaatgctcgacaatgcagtagaagaattaacattgatttccggccaaagaccggttgtgacaagagcgaaaaaatcaatcgcaggtttccgccttcgtgaagggatgccgattggcgcaaaagtaacgcttcgcggcgagcgcatgtacgaattcctcgataaactgatttcagtttcgcttccgcgtgtgcgcgacttccacggcgtatcgaaaaaatcgtttgacggccgcggaaactacacactcggcattaaagagcaactgatcttccctgaaattgattacgacaaagtcagcaaagtgcgcgggatggacatcgtcattgtcaccactgcgaacacggacgaagaatcacgtgaactgttaggcctgctcggaatgccattccaaaaataaagcggacgctaaaaagggaggcgaaaacgtggctaaaaaatcaatgattgcgaaacaaaaacgtgaaccgaagtataaagttcaggcttatacgcggtgcgaacgatgcggccggccgcattccgtcattcgtaaatttaaactttgccgtatttgtttccgcgaacttgcatataaaggtcaaattcctggcgtgaaaaaagccagctggtaaaacccgaatttgggaaggaggtaaaagaaatggtcatgactgatccgattgcagatttgcttacgcgtatccgtaatgcaaatacagtgcgtcatgaaaaattggaagtcccggcttccaagattaagagagagatcgccgagattttaaaacgtgaaggtttcgtgcgtgatgttgaatatatcgaggataacaaacaagggattatccggatcttcctgaaatacggcgcaaacaacgaacgcgtcattacagggatcaagcgtatcagcaaaccgggcctgcgcgtatacgcaaaagcaggtgaagtgccgaaagtgctgaacggacttggcatcgcaattgtttctacttctcagggcgttttaaccgacaaagaagcacggaaaaacaatgtcggcggagaaattttagcatacgtttggtaattatttgacgttgaacggaggtgtaaattatgtcacgtataggaaaaaaaccggttgaaattccatccggcgttacggtaaccattaacggagatacagttacggttaaagggcctaaaggtgagctgacccgcagcttcaaccctgatattaacattaccgtagaagacaatatcattcacgtaacacgcccttcagacagcaaaaaccaccgcgctttgcacggaacgacccgcgcactgctcgcaaacatggtggacggcgtgtcgaaaggcttcgaaaaatctttggaactggtcggggttggataccgcgcccaaaaacaaggcaaaaaactcgtattgaacgtcggctactcccatcctgttgaatttgaaccggaagaaggcctggaagtcgaagtgccttccaatacaaaaattgtcgtaaaaggcgtaagcaaagaacgcgtcggcgcatttgccgccaacattcgcgatgtccgtccgcctgaaccttataaaggcaaagggattcgttacgaaggcgaatatgtacgcagaaaagaaggtaaaaccggtaaataatgccgcctaggatgagaaaggagtgaattcgatgatcacgaagccggataaaaatcaagtacgcaaaaaaaggcatgcacgcgtccgcgcaaaattaagcggaacggctgaacgtccgcgcctgaatatctatcgttccaacaaaaatatttatgcccaattgattgatgatgcaaatggcgtcacactggccagcgcttccacgctcgataaagagttgagccttgagtcaaccggcaatgcggaagctgcacaaaaggtgggcgaattgattgcaaagcgcgcaatggaaaaaggcatcaaagaagttgttttcgaccgcggcggatacctctatcatggccgtgtcaaagcgcttgccgatgcagcccgtgagaacggattacaattttaatcaaaaaggaggggaaattttacatgctacgtattgacccaaacaaacttgagttagaagaacgtgttgttacgattaaccgcgttgccaaagtggtaaaagggggacgccgtttccgcttttccgcacttgtcgttgttggcgaccggaacggacatgtcggatttggaaccggcaaagcgcaggaagtgccggatgcgatccgcaaagctgttgaagatgcgaagaaaaatcttgttgaggtaccgatttcgggcacaacgattccgcacgaagttgtcggccacttcggtgcaggcaaaatcttgctgaaaccgggttcccctggtaccggtgttatcgccggcggccctgtccgtgcgatccttgaacttgcgggtattgcggatattacgtccaagtcgcttggttcaaacacaccgattaacatgatccgtgctacaatggacggcattaaacaattgaagcgtgcggatgaagttgcgaaactgcgcaataaatctgtcgaagaattattaggttaaggagggaacgctcatggcaaaattgaaaatcaccctcacccgcagtgtcatcggccgcccgcaggatcagcgcgaaacggtaaaagcgctcggcctgcgcaaagtcaaccagactgttgagaaagaagacaatgctgcaattcgcggcatgatcaataaagtgtcccatcttgtttccgtatcggaacaataattttcgattttaagataaggaggtgcaaccatgaaacttcatgaattaaaacctgcagaaggatcccgtaaaaaacgcaaccgtgtcggtcgtggtattggttccggcaacggaaaaacagccggcaaagggcacaaaggtcaaaacgctcgttccggcggcggtgtacgcctcggttttgaaggcggtcaaaccccgttgttccgccgtttgccaaaacgtggttttacgaacattaaccgtaaagagtatgccattgtgaaccttgacgttttaaaccgttttgaagacggcacggaagtaacgcctgctcttttattggaaacaggtgtcatcagcaaggaaaaatcgggtgtaaaagtgcttgcaaacggcaaacttgagaaaaaattgaccgtaaaagcacataaattctcctctgctgccaaagaagccatagaagctgccggcggtacagccgaggtgatttaatgttcaagacaatcgccaattttatgcgtgtgggtgagataagaaataaaattattttcaccctcctcatgctggtcgtattccgcataggagcctttattcctgttccttatgtggatgcttccgttttggatgcctccacccaaaacggtttagttggttttctaaacacttttgggggcggtgcgctgaagaacttttccatttttgcaatgggcattatgccatatatcacatcttccattatcgtgcagcttttgcaaatggatgttgtgccgaagtttgccgagtgggcaaaacagggtgaagtggggcgtcgtaagctgaatgagtttacacgctattttacggttatcctggctttgattgaaggcttcggcatgtcatatggctttaataatttggcgcaaggggcactgattacgaagtccggtttctggacgtatttgatcatcgcacttacgctgacagccggcaccacatttttaatgtggcttggcgaacaaattacggccaaaggtgtaggaaacgggatttccattttgattatggccggcattattgccgggattccgacagccatcaaccagatttacgcgcagcaaattgaaaatgccggttcccagctgtttttgaagattgttttgctggcttttcttgcattgattattctggccattgtggtcggagtcatctatttccagcaggcatcgagaaagataccggtccagtatgcccagcacatttccggcagggcaacaaccggcaggcagtcaacgcatttgcctttaaaggtcaatgctgccggggtcattccggttatctttgcgatttcgttcattattgcgccgcagacgatcgcttcgtttttcggttccagcagtgtggcaagcaccatccagtatatttttgattatacaaaaccggtcggagctttgatttatgtggcgttgattatcgctttctcgtacttttacgcattcgtacaagtcaatccggagcagcttgccgacaatttaaagaaacaaggcggctatattccggggatccgcccgggcaaaaacacacagcaatatgtcacttcggttttataccggctgacatttgtcggttcgatctttcttgctgtgattgccattctgcctgtcattttcacgaatgtcatcgggctcccggcttccgccagaatcggcggcacaagcctgctcgttgtgatcggggttgcgcttgaaacgatgctgcaactggaagcacagcttgttaaacgccattacagaggctttatcaaataaaaatggtttcgtttttttgagaccatgtcaggaataagggggctgtacgatgaatctagtgttaatgggccttcccggagccggtaaagggactcaagccgaaaaaatcattgataagtatgccattcctcacatttccaccggagacatgttccgggcggcaataaaggaagaaacggagctggggcttaaagccaagtcctttatggacaaaggcgaactggtccctgacgaagtaacgatcgggatcgtgcgcgaacggttaagcaaggatgactgcaaaaatggcttcctgcttgacggtttcccgcggacggttgcccaggcagaagctttggaaaatattttaagcagccttggcaaacagcttgactatgtcatcaatattgaggtggaccgggagattctgacagagcggctgaccggccggagaatctgtgaacattgcggtgcgacttaccatctcgtgtttaatccgccaaaaacggagggcgtttgcgacaaatgcggcggcccgctgtaccaacgggcggacgacaacgcagaaactgtcgggaaccggctcgatgtcaatatgaaacaaacccggccgctactggacttttatgaggaaaaaggctatttgcggaatgtaaacggccagcaggatattcatcaagtttttgcggatatcgatcaattgctgagccaactgggttaaacgtgaacgacttggtgaattcatgagagccgcaatcacgttggatggaaaccacctttggaagttttaaccggccggcttttcggccatgtcctgacggtaaaaaacttttcaagtttgatgcaatttccgcttaaaaaggttataatggttttcgtggcattttcaccgctggatatttcacgggtgaaatgacggctctgttttattggcgatttgcttcatccgttaacttgtaatcaatagatgaggaaggcggcttccgttgtcaggattgccagtaagcgtcattcgaacgtctctcatgcaattcaattctgtgcaaatggctttcgttcgttcacatgtatgccggacatgggattggtcaagactgacatgaaagaaccatgtaaccttgggaacgtttatcagctcttgccggcccctcggatcagccggtttacgtgaatatgcagcaggccgaccgcttcctgaagagggagttttggcgagcctgatcgttttaaggttttggaaaagtatcattgccaggtcctaaatgttaggaggagggagaaaagttcgatggcgaaagatgacgttattgaagttgagggcattgtgagcgaaactttgccgaatgccatgtttaaggtagaattagaaaatggtcacactgttcttgcacatgtgtcgggaaaaatccggatgaactttatccgcattttgccgggtgataaagtaacagttgaactgtctccgtatgatttgacccgcggtagaattacgtaccgctttaaataatgtagatacacggctttttcggtgaaacggaaagtctgcctggggaatctgtttggaaaaaaggtaccgggcttgtactccgtatattaaggagggtaaaccatgaaagttagaccatctgtgaagccgatctgcgaaaaatgcaaggttatccgcagaaaaggcaaagtaatggtaatctgtgaaaatccgaaacacaaacaaaaacaaggataaatttgaaggaggtgcacctgtatggctcgtattgccggtgttgacattccacgtgataaacgtgttgttatttctttaacatacatttacggaattggtaaatcaactgcacaaaaaattcttgctgaggccggaatttctgaagatacacgcgtccgcgacttaacagaggatgaagtaaacaaaattcgtgacatcgtggacaggctgaaagtagaaggagaccttcgccgtgaagtttctctgaacattaaacgcctgatggaaatcggatcttacagaggtctccgccaccgccgcggtcttcctgttcgcgggcaaaacacaaaaaacaatgcccgtacacgcaaaggcccgcgtaaaacggttgccggtaagaagaaataataagcaaaggaggttgttcatatggcacgcagaacaaatacgcgtaaacgccgcgtaagaaagaatattgaatcaggagtcgctcatattcgttccacttttaacaatacaatcgttacgatcacggatgtgcatgggaatgctgttgcatggtccagtgccggtgcgctcggtttcaaaggttcccgtaaatcaacgccgtttgctgcacaaatggctgctgaaacagccgcgaaagcatcgatggaacatgggatgaagtctttggaagtaactgtaaaaggacctggtgcaggccgtgaagccgccatccgtgccctgcaggctgccgggcttgaagttacagccattaaagacgtaacacctgtgccgcataatggttgccgcccgccaaaacgtcgccgtgtctgattttttttgtatagattttgtatccttgtcaataatgggatatgatgcataatctgcaaaaaaaatgatttgaatgatccagttgttatgcataatagggaattttgcatggggaatttcgaatagggctctttctggggtgctatacggggtttcgacgttttgaaggagggttaatttgaatgatcgaaattgaaaagccaaaaattgaaacggttgaggtcagcgatgacgctacttatggcaagttcgtcatagaaccgcttgagcgtggatatggtactactttgggtaactccttacgtcgtatcctattatcctcactcccgggtgccgctgtcacttccatccaaatcgatggcgtgatgcacgaattctcgacagttgaaggcgttgttgaagatgtgaccagcattattttgaacctcaaaaagctggcattaaaaatctattccgatgaggaaaaaacgcttgagattgatgttcagggagaaggcgctgtgacagcagccgatattacgcatgacagcgatgtggagattttaaatccggatctctatattgcgacggttgccgaaaacgggcatttgcgtatgcgcatgaccgccaaccaaggccgcggctatgttcctgctgatcaaaataagcgggaagaccatccaattggtgtcattccaatagattctatttataccccggttcaacgcgtgaactaccaggtcgaaaatacccgggtagggcaaatcagcaattatgataagctctcactggatgtcacgactgacgggagcatcggcccgaaagaagcaattgctttgggcgccaaaattttaaccgagcatttgaacatcttcgtcggactgacagatgaagcacaaaatgcggaaattatggtggaaaaagaagaagaccagaaagaaaaagtgcttgaaatgacaattgaggaacttgatctttcagtccgttcttataactgcctgaaacgtgccggcatcaataccgttcaggaactggccaataaaacggaagaagatatgatgaaagtccggaatcttggccgcaagtcccttgaagaagtcaaagcaaagctcgaagatttgggcttaggtttgcgtaaagacgactgagccggttagaaggcaaagcgattaatccaacataagggagggaacttcatgccttacagaaagttaggacgcacaagcgcccaacgtaaagcattactgcgcgatttggcaacagaccttatcattaatgaacgtatcgaaacaactgaagcacgcgcaaaagaattacgctcagttgttgaaaaattagttacgcttggaaaacgcggtgatcttcatgcccgtcgccaggctgctgcatttgtacgccatgaaacagctgacgaagaaacaaaacaggatgctgttcaaaaattattctcggtcattgcagaacgttacgcggatcgccggggcggctacacccgcatcttgaaagtaggcccgcgccgcggagatggtgcaccggttgccattattgaattcgttgaaaaagaaaagcaagatcagaatcaagagcaagatcaagagcaagtaaacgaatgattttcttgagggctggacagttgaaaggttcttaactgcttctttgccctttttctatcttttttcggtttgtaatcgcagactttgcagcgctgggatggtctgtacttgcgaaaccctttcgtttatgtgtgatgcaataaactgtgagtgttacgatgggcgcattttgtgcccgtctagctcttgcacccctttttatttctgtgcgccggattgttaacgtctacactgaagaggggtgcaggcttttttattatggggatattttacccgccaaactgcacgacaatacggtaaaatataaatacaagcaaacgggcgaaacattggttatcatcgttcggaagagaagccgtttgtaaacgggctgttgctgacgcgtggcgaggcgcataaaggctgggtaaacacccaagcaactttgcggtgccgccatcaggatggaaatgaagttgaagagaatagcgaaggattgcttagcatgttttaaccgtgctaaaaagcaggttacagaggaggaatccggcattggcagacagcacgaacgtgatcattgacatcgaccaggtttccttccgttacccggaacaggaaacgtatgcactaacaaatatttcttttcaagtttataaaggcgagtggctggccattgtcgggcataacggatccggaaagtctacgctggcgaggctcttaaacggcttgcagtttcccggaaagggcacgataacggtttccggcctcaagttgtcggatgaaaatgtctgggagatcagaaggcgcgtcggcatggtgtttcaaaatcccgacaaccagtttgtcggtacaaccgttcaggatgatgtcgcattcgggctggaaaatcacggtgtgccgcgtgaggaaatggtgaaacgcgtccatgatgccttaaagcgggtgcggatgtcggactttctggaccgcgaaccgcaccatttatcaggcgggcaaaaacaacgggtggcgatcgccgggatcatcgcgctaaagccggaagtgatcattttggatgaagccacgtccatgctcgatccggtcggccgcaaagaagtgctggagacgattcgacagctgaaacaagaagcagggctgaccgtcatttcgattacccatgatcttgaagaagctgcccaggcggaacggatgatcgtgatgaaccgcggcgaggtctaccgggaaggcacaccgcgtgacatttttcaaatggatgagacattgactgcgcttggccttgatattccgttcccggtcaaaatggcaaaagcgctaaaagcaaggggcttggacttaccggaaatttatttaacagatgaagaattggtggatgcactatggacattgcatttgaacaagtagaataccggtatcagccgaatacgccgtttgaaaggcttgcactctatgacatttccctcgccatcccgtccggccgctatatcgccgtgatcgggcataccggctcaggtaaatcgacgctgctgcagcatttgaatgccctgcttcagccgacaaaaggaaaagtaacaatcggcagccgggtgattgaagccggaaaaaaggaaaaaaacttgaaggcgatccggcaaaaagtcgggattgtgttccagtttcctgaacaccagctgtttgaagaaacggtggaaaaagacatctgtttcggcccgaagaatttcggcgttccggaaaaagaagcgaaacagcgggcgagggagctcatccggcttgtcgggctttcagaagagattcttgcaaaatcgccgtttgacctgtcaggcgggcaaatgcggcgagttgccatcgctggtgtgcttgcgatggaaccggacgtgcttgtgctggacgagccgactgccgggcttgatccgcgcgggcgccacgagatgatgggcatgttttacgaattgcaccagaagaagcatttaacgactgtgcttgttacccacagcatggaagatgccgccctatatgccgatgaactcgtcattttgcatcaggggaaattgatgaaaaaaggcgcaccccgtgacatcttttccgatcctggattgcttgaaaaatggggattaagcgtgccggagattgtccgcttccagacgatgctcgaggaaaaaaccggtatgaagttcaataagacatgcctgacagtggaagaacttgcggaagcattgcaatcggttttgaaacggggtgggcgcgtatgatggaaaaaatgattttcgggcgctatattccgggcgattccgtcattcaccggatggatccacgttcaaaattgatttttgtatttgtctttatttgtattgtatttttggccaataatgcggtcacctacgggattctggtaatctttaccttgcttgtgatgctggtttcaagagttcctgtccgcttttttattaaagggttattgccgattttatggctggtcatttttactttttttctgcagctatttttcaatcgcgagggcagccttgttttccattatgcatttattcatatttatagtgaagggatccggcagggtgtgtttatttcgctcaggtttatgctgctgatctttttaacatcgcttttgacgctgacgacaacgccgatttcgctgacagacgggattgaaatgctgcttgcgccgctccggaaagtaaaatttccggtccatgaactggcattaatgatgtccatttccctgcggtttattccgacattaatggacgagacggaaaaaatcatgaaggcgcagatggcccggggtgtcgatttttccggcgggagtataaaagaccgggtgaaagccattattcctctattaattccgctgtttgtcagttcgttcaaacgtgcggaagagctggcaacggcaatggaggcccggggttaccagggcggggaggggcggacgaaataccgcctgctcgtctggcgtacggctgatacgctgtccatttgtgcgctggccgtcgttattgtcctgctcgtgctgttccgtgacggggggattttatgaagcgcgtaaaatgtacggtcagttacgatggttcccgattcgcggggtaccaggtccagccggggcagcggacggtccagcaggaaattgaaaaggcgctggccactcttcataaaggccgccacgtgaaaacggcggcttccggaaggacggatgccggcgtgcacgcgatggggcaggtgatccatttcgatacggatctttctattccggaaacaagctggccggccgctttaaacagcctgcttccaggcgatatttcggtctcgaaagcggcatatgcggaccctgcttttcacgcccgctactcggtaaaagagaaggaataccgctaccggatctatttttctcatgtccgcagtccgtttaagcaccgttacgcgttaagggtctggtattcgcttgatatcgaggcgatggaagcagcagctgagaccgtgctcggcacccatgattttacgagtttttgttcagcgaaaacagaggtggaagacaagattcgtacgttaaaagagattcggtttttgcagcaggacgatgaattggtgatctgttttaaaggaaacggttttttatacaatatggtacggatcttaaccggcactttgcttgaaatcggaagtggcaaacgcgaccccggtgaaatgcgcgaaatccttgaaaaacggaaccggatttatgcgggcaaaaccgcggcgccggaagggttgtatttatggaaagtatcttattgacggagcatgaatccgcatgatcaaaagaagataaaaacaaccgggccaggcgtaacattcacttgacattcttgccccaaaacgatattataacctatggtattgttttttaactccacgataagccccggaaacttattgtgataatgacaatagatcatgactgtgtttttgtgaatattttttaggagggtaactcatgcgtacgacttatatggcaaaagcaaacgacgttgaacgtaaatggtacgtagtggatgctgaaggcaaaacccttgggcgcctcgcttctgaagtggcatccattttacgcggcaaacataaaccaactttcacaccgcacgtggatacgggcgatcatgtgatcatcttgaatgcttctaaaatagaattgacaggcaaaaaactggaagacaaaatttactaccgtcacagccagtttgcaggcggtttgaaacaacgtacagcaggcgaaatgcgaacgaaatatccggaaaaaatgctggaactggctattaaaggcatgcttccgaaaggttctcttggacgccaaatgtttaaaaaattacatgtgtatgctggtacagagcatccgcatgaagcacaaaaaccggaagtttacgaacttcgcggataattttaaaaggagggcattattttggcacaagtacaatacgccggaactggacgccgcaaaagttctgttgcacgtgtccgcttagttcctggaaatggcaatattacggtgaacgggcgtgatgtaaaagattacattccgttcgaagctttagttgaagtgattaaacaaccattgaatataacagaaacaaacggcagctacgatgttctcgtaaacgtaagaggcggcggtttcacaggccaagctggcgcaatccgccacggtattgcccgcgcattgctgcaggctgatcctgaataccgtgcagtgttaaaacgcgcaggccttctgacacgtgacgcccgtatgaaagaacggaagaaatacggtctcaaaggcgctcgtcgtgcacctcagttctcgaaacgttaaattattggcacttcaaaggctctcttcacttatgtggggagggtcttttttatgtccaaaaaaacccgtgaccacatgtgacgcagcaaatgcaaaaagactgttataacaataaacttccgtaccgaaaagattcgagaggagatagttcatatcttagatattcaagcaatactgggacaagttgctccttgtagattgaaaagggtgatccggcataatttaccggattgcaacgtatgaatatattagtttgaagtttatttgtgaagggtgatcacatggatgaagcaacaaacgacaggaagaaagtgagcgtgaatagaaaggatgagcaactagaacagttccgtgttaacaatgtaggtaagaaacttacaaccaatgagtcagtaaagatttcaaatgatgaacagactttaaaagctggagtccgcggccctacattaatggagacttttatttttttgaaaaacagatgcattttgaccatgaacggataccggaaagagttgttcaagcaagaggtttcggggcacatggagaatttgaattgtatagatcaatgaaacaatatacaaaagcttgctttctacagaaacccggggaaaagacacccgtatttgttaggttttccaacatgcaaggaaataaaggctcaagtgatacgacattgggtccacgcggcttttcaaccaagttttatacaagggaagggaattacgatttattagcgctctcattccctgtattcattcttaacgatgcctttaagttagcggatgcgatacatgcgcttaatccggagccacataatgatatcccacaagcctcacccgctcatgatcatttttgggattttgttgcgaataatcaatcttctgctcatttcattatgtgggcaatgtctgatcgaaccgctcccagaagttggcgaatgatgcaagggttcagtattaatacctttcgatttgtaaacgatgatggaaaagctacttttgtaagatttcattggaagcctgtccttggcgttcattcattactaatcgatgaagcgcaaattattggtggggtggaccccgacttccatcgaagagacctgtgggagtccattgagcttggagcttaccctgtatttgaattaggtgtacaaatgattgatgaggatgatgaatttaagtatggtttcgatattttagaccctaccaaattatggccggaagaaatggttcccgtagaaattatcgggaaaatgacattaaataaaaatgttgataatttctttgcggaggtagaacaggtagcgtttaatccagcaaatgtgatcccaggaatagatttttccaatgatccggttttacaaggcagattatttgcttatcgggatacacatatgcaccgacttggcgggccaaacttcaatgaaataccgatcaatcgtcccatctgcccggttcacaataaccagcaaggcgggtatatgcaacaaaaaatcaatgttggaaaaataaactatcataaaaattccttagcgcataatactcctgccacttccagtccggcagaaggaggttatgtgcattacaaggagaaggtagaggggcacaagattaaagcggaaagtaaatcgtttaaagattacttttcgcaggccagactggtttgaaatagtatgtcgtctgttgagaagcatattacacaagcattttgctttcagctcggaaacgtgaaaagccaatcagttcgccagcaaggcgttgatatgtttgccaatgttgatgaaggtttggcaaccactattgctgaatatgttggtgtgaatcgtccgagcggggtgcaagttccagttacagcaagttccccggctcttagcatgatgaatacgccaaaatatccatattcgcttaaagtgggcgttctgatcggcaatcattttaatgggaaagaggtaaaaactgtcattggtcttttgcggaaatatggtgtttttatcgaatttgttggcgaaaagtttggaacggtgacagggacagatggcacgaaattcaaagtgaataaaacatttctaacaacaaatcccaacctgtttgattcactctatatcgttggcggaagttccggaaatgaaacaaggttcagtcaggatatcatgcgttttgtaagtgaagcatacaaatattataaaccgattggtgttgcaacaactgcacatacttatattaaagcaacagagaagaataacttactcggggtcgtttttgccgcaaataatccttacttcggtgaggagtttgtctctgctatcgctcagcaacgtttttggaatagaaaataatatggttatttatatgggggcacgctcgttctagcatctcctgaataataattgagcatataaatattttgtaaagatgataaaattgataatccttcgactacattttaaacatcaacgataaaaaaacagcaaagccgccgtaagcagcggctttgccctctctcccgccattatggcaccagttcttttatttccttcccgtccacaaagaaaggcgcaggcacgttcatcatccggtaaagcgtcggggcaatgtcgattaaagaaagccggcgcgatacctttttatgcggaatgtcctttccgtatgcaagcagaaccgggcgcagatcactcctttccgggttgccaccgtggtttctaagttcggacggggcatggaaagaggaagagatgtccgaatccatcatgtaacctctcgctgcgacaagcgtcacatcaccggcatgcgggtggtgaaaccactcactttttttgctttgcgctttgatcacggactcgtacggccgggccgggtcattttttaccgtatcatacagggacgataccgtttcttttgtagtggaccagctgctatgcccgtttgttatgccttgccaccagtccgaaagatagaaacccgccagtttggattttgaagcaaggatgcgcgggtcgcggacagacgaaaagatttttgccacctcctgctgcacattcccgtaatcttgtttagaaacaattccgcctttcttacttcctttcaaattgatgtagacatgggccatcgtgccagaagcaactgcatacgattttgtccggttcaaatcaatttctccgtttttctttaaaacaagcagaccgtgttttttaagctcgtaattcggagagagcccagtgtgcatcggttccatgccgtggtctgacacaacaaacaatttgtcattttccccaagtgactgcaatgtttttccaactgtatggtcggccaattgatacgcccaacggacccgggccgcatatgtttttgcttttttatcggaatagccggactggcgcgggtctgttgacaaataggcatgttcttcatggtcgatttgcggctcataaaacatgagcagatccggtttatagcgatccttaatgaataaggagacattttgcacccattgggcaaagcgggtggagatgtcttcatattctgtccgggtaatccagccttttttgaaggcagccaagtcttcatccacagggaaaaatccgaacaggctgtttatcgttttggcaaaatcccccggtcccttgattgatgcagatgtgaccgctgtccggtacatttccgctttcgacagggtgcggtcggtttttttcatcttgaaccagaagccggccggttgatgattttcatttaacgtgaaactgccccattgattgacacccactcgcgcatctttatcttcaatcgttttgttgtccgaaaaatagaaaaggtcatacgcatcatggtgaagagcggcagccagcacatgaatggtccggttctttgctcccttaagttttaaccggtaaacggcttcttttagcggtttccggcttttcggggcattgttccatcctttggcgggacggaatgtaagatggacaaggtcactttttgcaaaagtatccttgtaatagatggcgtaatcggcatgcgcctttgaaacttccgggttggagccgggaaagcagatcgtcgccgtcacttttccgtgtttccgtccttcagaccagatggccgggacgtccagtgcagaccagaaggcgtcctctgtttccgtcagtttaaaatttttattgtgaaatgcgttgctgaccaggccggttttctccggtttggcccctgttgcaatggaagcatgggaggcggcggtgagggacggataaaccgctgtaatgtctttggcatcaaatccatgcttcataattttgtttaaatgcggcagttcctttttatgttcgtggacataatcgtttttcatgccgtcaaaagacacgacaacaatggtccctttttcagatgcagccaggggtcggcccggaacaagcgcacaaaggagggcggccggcaggatgtactgaagcaaacggctgaatcgtttcatggaccttccttccttcctttcttatatgtactgtcagcattctattttcccttgatggctgcaggtaaacaaagcgcggaaacagggaagctaaggcactggctaacttgttcatcattttttaagcatcttcataatggaattgcgatctccgccagcggcaacttaggacccattctccatccgaacttacggattaaagcggatcattttttcacacgaagaacggtttgatcatacacttgattgtcactttaaattgccggcacctttcatttgccatagctggaagacgaaacgaagctgaggcagaaaatcaatcttttcttcccccggcactgcaaacaagccttgacgatttgatgcagcgtgtagacatcacggagatacttgcttgcccttgaaggaagtctttcagtccagggcatatcatgagcggtcgagaagctataccaggattatttaaatgattacggcgagctgtaccgtgatccgccaagatctgcaaaaaaataaatgcaaaaataatctgtttaatgctaaaataaatattacggaagtattccaattgtttttataggaaaaatgcaaacgagtggaggaaattggaacatggctttttcaacgagcatcccgcacggcggtatattggtaaaccgggaaaaccacagtgcggaagctttaaaacaggcagaacaattaccggcattaaccgtttccgactggagcatctccgacctggaactgatcggtatcggcggcttcagcccgctgaccgggtttatggggaagcaggattatgaaacggttgtggaaaatatgcggctttcaaacggccttatctggagtattccgatcacgcttcccgtaacagaagaggaagcggaaaggtttgaaaccggcgaaacgctcgcattaaaaggtgcagacggcgtgatctacggcacgctcacactggaagaaaagtatacagtggacaaagaacgggaagcaaggctcgtgtacgggacaaccgacccggcgcaccccggcgttaaacgcttatatgaaaacggggatgtgtatcttgcagggccggttacgcttttaaaccgcccgaatcatgacgagtttgccgcttattataaagatccgaaagaaacaagggcattgttcgcatccctcggctggaaaacgattgtcggcttccagacgcgcaacccggtccaccgcgcccatgaatacattcagaaaagcgcgcttgaaatcgttgacgggctgcttttaaacccgcttgtcggcgagacaaaaagcgatgatattccggcggatatccggatggaaagttacgaagtgattttgaaacattattatccaaaagatcgtgtgcgccttgttatttaccctgccgccatgcgctatgcaggcccgcgggaagcaatcctgcatgcgctcgtccgtaaaaattacggctgcacccatttcattgtcggccgggaccatgccggtgtcggcgattattatgggacgtatgaagcacaggaactgatcagcactgtggagcaggaactgggcatcaccattttaaaatttgagcatgcgttttactgcacgaaatgcggcaatatggccacaacgaaaacctgtccgcacggaaaagaagaccatattcatttgagcgggacaaaagtgcgcgaaatgctgcgcgccggccaaaaaccgccgaaagaattttcccggccggaagtggcagaagtgctgatcaaagggatgaaagtgcacaattaaacgtccgcaaatcataaggagggaaccggccgcatggcgaaagcaaccaatatcacatggcatgaaacccaaattaaaaaagaagaccgccggaggttaaacgggcactccagcgcagtcctctggtttaccgggttatccggggcggggaaatccacgctgtccgtcgccgttgaacaggaactccacgggcgggggatccgcacgtatatcctcgatggcgataatatccgccacgggttgaataaaaatctcgggttttccccggaagaccggaaagaaaatatccgccgcatcggagaggtatcaaaactgttcgtggatgccggcgtaatggtgctgacggcgttcatttcaccgtaccgtgctgacagggacatggtgcgcgaactggtcgaagataatgaattcgtagagatttacgtgaactgcccgctggaagaatgtgaacagcgggacccgaaaggcttatacaaaaaagcccgcaatggggaaatacaaaattttaccggtatagatgccccttatgaagccccggaacatccggaacttgtcgtggaaaccgacaaacagccgttggaacaggctgtcgggcaggtgatccgctttttggaagaaaaagggtacatcgaaaagtagccggtcttataaacggcaaacgtgcagcaggtgcaaaaccttgctgcacgtttttctacatagggatgtaagattatgcaacaaaatgctggaaatatgcaaaatcctgttttcatccggaattttttgtgctatggtatggacgttgtgatttattttaaccagatgcgtatgatagataaatggagatgaacatacgatggcaacacaaaaatccggcctgaaacggcgtttaaaggcgcggcatctgaccatgatatcactcggcggctcgatcgggaccgggctttttctcggaagcggcgccgcgatttaccaggcgggcccggggggagcgctgcttgcctatttggttatcggtgtgatggtctattttattatgacaagcctcggggaactggcttcatttatgccgacaagcggggcattcagtacgtatgcaacccgctttattgatccggcgctcggttttgcgctcggctggaattactggtacagctgggccatttgtcttgcagcggaactgtcggcatcgacgctggtcatgaaattttggtttccgcacagccccagctggttgtggagcggcctgtttttgctcgtgatttttcttttgaacattttgtccgtgagaggctatggcgaaggagagtactggttttcctttgtcaaagtggcgaccattatcctttttattgttaccggctttttgatgatatttggcatattgggcggggcaccggccggctttaaaaactttacaatcggggatgcgcctttccacggtggtgcgcttgccgtgcttggcgtgttcattacagccggattttcattccaggggacggaaattgtcggcgttgcagccggggaaagcgagaatccgcgcaaaaacgtgccgaaagcaatcaaaagcattttctggcgcattttgttgttttatgtccttgcaattcttgtcatcgggctgattatcccttatacgacaaaaagtttgcaaagtacggatgtaatggtgagcccgtttacgcttgtctttaaaaaagcggggcttgcatttgctgcatccctgatgaatgcggtcattttaacggctgtgctgtcggcgggaaactcgagcctgtatgcttccacaaggattttgtatgcaatggcccatgaaggccaggcgccgaagtttttcggcaaactgaacaaacgcggtgtgccggtcgcagcccttgttgccacggccattgtcggcgcgcttgcatttctcgcatccgcattcggggacggcgccatttatatctggctgttgaatgcagcgggcgtcacgggctttattttctggctcgggattgccgccagccattaccgtttccggaaagcgtatctcgcccagggacgttcacttgacgatctcccttaccatgcgaaatggtacccgttcggcccgatttttgcgctgattgtcggcgtgatcgttattcttgcgcaggattatcaggcattcctcggcggccgtatcgactggatgagcgccattgccgcgtatctcggcatcccgctttttgccatcatgtggctcggctacaagctcgtaaagcggacaaaagtcatcccgcttgaggcatgccggattgatgaccggggatttgaccaggagccggagcatactgaaaaaaaggatgcgcgctcctgagcggtgtgttggcttaaagcgcgcgcccatgttgcgatatcgattccttgtttggaaatcattataaagtatcgacgcctctacgcccgcgtacaataccggtaaggagtgggtagagatgaatgaagtcattaccaccctgtctgcgaaaagacgggagaggcaaatgaaggcggaacgcaatttgctccgcgaactgccggttgaagtgctgaagaaaagcttccagtcccatttcggttcgttccggatcaacgggggagcgtggatggagcaggggatcgaagaagggtgttacgatgtcgccattgaagcctatttattgggcggccattacagccggttcgggtattacggcgagccggccgagcaggcaaagaaacggtgcgaaaccgaattaaagcatattacagatactctgtacaatttttggctttattggacattcggcaatgatacgatgcaggagtccatttactatacatgcgagcagtttgccgactacttttggtcttacggctttaaaaaaggcgaacaaaggcggaaactgcggcttcattaggggatgcccgtttgcggctcccttttttgcagttctattttcctcccttgtcccataacttttcaataaggacagggagagggagattgtgatgaaacggaaaatcaaaattgcggggtttctgcttggtgtcacccttttatttttacttgtgcagtttgagtttttccaaaaagatacgtggcgcccgtggaatctgccgctttccgggaaaatcatctatctggatccggggcacggggggccggacggcggggcaacgggagatgaagtgctggaaaaagatgttgccttaagtgtggcggccaaaatcaaagactatcttcagcagcagggcgcgcttgttattatgacgcgcgaaacggatacagaccttgctgataacgagacaaagggctacagccgccgcaaagtggaggatttaagaaaaaggctttccctgatcaacgagtcggaagcggatctttttatcagcatccatctgaacgccattccgcaatcacagtggcacggcgcccagactttttacgccccgactatgattgaaaataaaaggatcgccacgtttatccaggcggagctggtccggaatctcgaaaatacaaaccgggcttccaaaacattgtctaatgtgtatttgctgaagcatgcgaaaaaaccgggctgccttgtggaaatcgggtttttgtccaatcccggggagcgggagcaattaaaatccgatgcgtaccagacaaaggtggcggcatccatttatgaagggattatgcgctactttacaaaagaaaaggacttaaagaactgacaagcatccggagccgttccagcgcaaaacactgccattgtatggtatactggaatcaagctggaaacgacttcattttaaggatggtgtagaaaatgttgacggaacaacaggtttacgacgtgttaaaagggtttgaagatccttttttacataaaacgctggaagaaacaaaagggatcctcgaaatcaaaatcaaagaagagatccagcatgtcagtgtcaaagtagcgattgccaaaactggtacaagcgaacagctgcagctgcagatggccattgtgaaagcattgaaggggattggcgcgaatacagtcggcatccgtttcggcgaactgccgaaagaaacgctcgaccggttccgcgatttgttgcaggaagacaacaaaaacccgctcggctccgccaaaacggaatttatcgccattgcaagcggcaagggcggcgttgggaaatcgaccgtttccgtcaatttggcggttgcactcgcccgccttgggaaaaaggtcggcctgattgatgccgatatttacggattcagcgtgccggacatgatgggcattatgcagcgtccggttgtccgcggagaaagaattatcccggtggaacggttcggggtcaaggtcatttcgatgggcttttttgtagaagacaatgcgccggtgatctggcgcgggccgatgcttggcaaaatgctgaacaatttcttccatgaagtggaatggggcaacctcgattatttgctgcttgacttgccgccgggcaccggggatgtggcgctcgatatccattcgatgctgccgcgctgcaatgagattatcgtgacaaccccgcatccgactgcggctttcgttgcggcacgggccggcgcgatggcactccggacggaacacaatttgctcggtgtcattgaaaatatggcttattttgaaagcaaggtgaccggcgaacgcgagtatgtatttggtcgcggcggcggggaaaaacttgccgaagaattgcggaccgaagtgctcggtcagctcccgcttcagcagccggactggaatgaacatgatttcgcgccgtccatctatgccgaagaccaccggctcggaaaaatttatacggaaatcgcacaaaaaattgtggacaagctgaaaaaataaatgtggaaagcggcggagccaaatcccgccgctactttttgtctttcatcgttttcgccgctttcagcagactgtcttccattttcgctttaaaagccgggtcattaaacgtatcgatgacaacctcctgcatggttttccgcatttctttgctctttagcatcgtttgcacttctttttcgtaagccgggtcttttaaaatatccatcatcattgcctggtaatccggatccttcatcaaacttttcaacagcgctttgttttcagttttcatgctgtctgcaaccgcggcggcaaatttcggatcctgcatggcttctctccaaaaagccttgcctttatcggaagttaatgtttgttcgatcgcttctttcatgtacgccttgtcaatgaccagattctttttcattccgtcgcttgtaatcacgtcctgcagcgctttttttccttcatcggttttcaatatgtcaatgaccatttttttcgtctggttataatccgcttgcccgcctgttgaagcctcgcccgagcaggctgtaagggcagcgcaaaggctgatcaggagcaaaacggttcttggtttcatgcttttggctcccttcttcattctatctttaatatgtgaagttcttttcggattatgcgctcggcggggaggcttaaaagcactggaattttttcccgggaccggagcctgatcgtgctacagctctgcaaaaaccggcttcatcgtgcggattggtaaaacagtacagttgggaaagccggcatgatgtgctggatttttctcatgattctctgttacaataaaggtactttaaaggcaaagggggatggggattgacaagccggaactgggttcgtttcttttttgccgctcttgccatcggaggggtgtcagccgggattctcgggtttttcgtccgctggccggaaatggcgccttattttgcacatgcggatcttttgtccatcgctggcgcgtttttctggtttgcggggttgggcttgattttcagtcttgtcagtcaggtaggtttcttcgcctggttaaccgtgcaccagctcgggcttgacattttccgttcgcggcttgtttggcaggccattcagcttgttgcagcctgttatgtactgttcgattttgtgtacttccgcgcggatacccgccagtccctgctgtttgcagcactgatccttgtgtccgcgtttgtggcggcagctgctaagacgaagcaggcaaaaagtgcaggggcttttattcctgccttgtttttcatggtggcagtgaccattctcgagtgggtgccagctttgcgtgtcaatagcatatcctcgctttatcttatgcttttcccgcttctcatctgcaatgcttaccagctgcttgcgcttccacattttttaaagcgctcccaaaaggaaaaagaggaaaaagcagcattgcgcaagatcgcagaagaaaagacggcaaactaaaaccggagcctgatggggtatccggtttttgctgtctgggcagtaaatgcataaaaattttctcagctggcaatagacacgataacagtgggaacgcttgaaacgcccgcggcccatgaaaaaagcaatagaagagtccatggcttctgctccatacgacacagagcaccggatgattccatttttgcaaccgcagcatttttccggtaaaggatgccgcggccggaatccatggttcatgaccgcggtttcgatcatttttgaaaccagtcggcccctttgtccatatggaggaaggggatatccgtatccacttcgccggtgatcttttcaatgggcaagtcttctcctgacagccatttggcaaagtcaattttcaccggctagcagtcaccgcctaaagcgaaccaggcttccatttgctttagcaggtaagcggaagtatggattgtgcccgcccagctagcgtatagttctgaaaaaacgcctttatcccggctatttaataattgaaacgcgtcccgggcgctggatagatgccctttttcctgttccaaaatggcggttctgcgcatcgaatcgctgagatgatgccggttttctttgctgagggtttcaaaatgattggtgcaaatatctccgttccgcacggcgaccgcgcgcggagaggcttcgacaatccgggtttccccgcttttatcataaacgacatagctgaatgaatggcggtgcggaatttcttttaacatggcaacggcttcgtcaatatttacgcatgattccagtagcagcctgccaatcatgcagcaaataaacccgtcgccgggactttttcgatggataaacgtatagccgatggcgagccctttttcattcatgccgtccatccgcccggtgacgcgctggctcggcccggcaatcgcgtacccctggtcggttggctggtacaggacatagcgtccttcataggttttaggatggtaatcatagttgcggatgagatagccatcgcctgttaaaatcgagcagcctgattttgtgtaatccacccggtagccgccaaattcctgcaaaactttttccatcggccatttcagtgcttcctgcaatccgcacaactcgtcccagattccgggtgcaaagcgggtgattgcgtctttcgtttcgttaaggtcgattacaaaccgcggttttctgactttccattgattgtcgcggttttggatggaaagggattcttttaatgcaagcccctgcatataaccgaatttttcatgtgacccgcgaaattggaccactgtgctgaaaatttgcttcattattccattcacctgcaagcccatttggatatcctttcatatcattcattttaacacattgtatttctcttctcctaacaacgatataccaagtgggcctgtggctttaaggaatcactttcgtttctgctttgccgtttgcaatcatttcggaaacggtcacaaattttcctttatccgacaagtggcggatgatttgcggcagggctttgttcgtctgctttgcggcatcagaagcgtgcagcaggatgatatccccgttttcggctgtgcttgctttttcaataatttttgcggtgcccgggtttttccagtcatcggtgttgacgctccagtgaaccattgtaagccccagttggtccgcaatttttaatgccgttttgtcaaaatggccggtcggggaacgcaaaagttttacatcctttatttcaagttttttaaacacttcttgtgccttctgcatatcatgccgcactttagccggttcttcatccgtgtaatccacataggcataaccgaggcttccgatctcatatccggctttttcaatcctattcacaatatccgggtgctgttccgcccacgcgcctgacaggaaaaaggttgcggactttacgccgtttttctgcagcgttttcaagatagggacggctttttcatcgccccagccaatattaaaagttaacgcaatgccgttttctcctttaaaaacggctttcggggtgccttttgctgaaaaagctgccgtctgcgccagtgtttgggtatagatcaataaggcagtaaaaaacgagacaatgacaatgaaaagatacggtttccagtttcgcgatttcgtatggtgcatgattcaacctcccgttaaaaactgcacttgtcttattgtatgcgccattttttcaggattatgcaaggaaaagtgctgtgatattttccttaaatttggtaaaaatagacgtaccatgaacagaaagggtgcatgcgggtgttaggtcttgtcgtccatgaaaaagagctgctggaactgcagtatttgttgaaaagagaaatggaagaaattttacttgacctgaatgatgagcggattgagcgggtcatcaaaagggccatgaaagaacggtaccggattctttttaagctcctgacaaaagtcgcgccccaaagcgaatatgcccaattcgccgtgtcctataggcgggaaatgaaacagtaaagagcggaggcagccgctcttttttttacggtcttttggaaaagaagaagcgaagagcgttctggaaaaagggaaatcacggaccttgaccggaaagaaggacgcgagttgtcccggccgcccgggtgagccgcacccttttgatcactctttcacaaaaagtcaataggcctggaagaataattttccagaaaaataatttgtcaaataatattcgacagtttttaaccgaattgtcacatggctcctatctgtaccataaaaagattaaatataatataagtgtaatgataaagtaacggaaatatggaagaggaggggattttgggaaatgagtgaagtcatattggcacggacccagtttgcaacgacaaccttgttccacttcattttcgtgccgctttcaatcggattggcatttattgtcgctgtcatgcaaacgctttacatggtgaaaaagaaagaaatttacaagaaaatgacgaagttttggggaacctttttcctcatcaacttcgcagtcggagtggtgaccgggattatccaggaattccaattcgggatgaactggtcgacctactcgcggttcgtcggggacgtattcggcgcaccgcttgcgattgaagcgctgcttgcgttctttatggagtcgactttcatcggcctatggattttcggttgggacagactcccgaaaaaactgcatctggcctgcatctggctcgtctcgatcggaacgatgctgtcggcgctctggattatggccgcaaactcgttcatgcaaaatccggtcggctatacgattcacaatggccgtgccgaaatgaacaattttgccgccgtgctgttgaaccaaaaattgcaggtggcttacccgcacattattttcggcagccttgccaccggtgcgtttttcatcgccggcgtttcggcctggaatttgatcaggaaaaaagaagtggcctttttcaaacggtctgttgccatcgcacttatcgttggtcttctcagcgggctcggccttgccttttccgggcacagccaggcacgttatctcattaatgtccagccgatgaaaatggctgctgcggaaggcatctggcaaaacaccggggaccctgcgccgtggacattgtttagtgtcattgatacgaaaaataaaaagtcggaatacagggtgcaaattccgtacttgctgagctacttatcctatggcaaattttccggatctgtcaaagggatgaacgagctgcaaaaagaatacacacaaaaatacggggcaggcaattatattccgcctgtaaaaacaacgttttggagcttccggatcatggttgccaccggcggcattatgatcctgatgagtttgatcggcctgtaccttgtctggaagaaaaaaattgaaaacagcatgcgttacttgaaatggctgttcccttgcatgtttatcccgacgatcggcaactcgttcggctggattatgtctgaaatgggccggcagccatgggtggtaaacggcttgatgaaaacaagtgcgggcgtttcgccgaatgtttcggccggcgagctgctgttttcactggttgcgttctcgattgtctatacgctgcttgccgtggcaatggcttacctgtttatccgcgttattaaacagggcccgcaggcaaaaccgatggaagacattactgcatcggatcctttcaatacaaggagggttgtataatgcagttaaatgaattgtggtttttgctcgtttgtgtgttatttgtcggatttgtatttctggaaggttttgatttcggagtcgggatgagcacaaaattccttgccaaaaatgagacggaaaaacgggtgctcattaatacgatcgggccgttctgggatgccaatgaagtatggctcctgacagcgggcggcgccatgtttgctgctttcccgaactggtatgccacgctttttagcggctattaccttgcctttgtcgtcctgctgcttgcgcttattgccagaggggttgcctttgaattccgcggcaaactccaggcaagcaaatggaaaggtatttgggactgggccattttgcttggaagcctcctgccgccgtttttgcttggtgctctgttttccgggatgatcaaggggcttccgattgaccgctcgatgacgatgcatgccggatttttcgacatcgtcaacctctacacgatcgtcggcgggcttgcttttgtcgctcttgtctatctgcatggcctgatgtttatccgtttaaaaacggatggcgaaatccgtgaacgtgccggaaaagccgcgatcaaaatgtatatcgctacaggcgccgtcgttgtcctgtttaccgtattaaccgctgtttttacagacgcgtttgtgaaacggggtgccattttaattccggtctatgccgttgccatcgtgctttatctggcactgtatccgcttttgcggaataaaaaagaaggattgagttttgccgtaaccgggttgattttaattcttgtaaccgtctcgtttttcatcgcacttttcccgaacgtgctgatcagttcaatgggggcggcgaacaacttgacgctttataaagcatcgtcaagcccgtattcgttaaaaatcatgacgatcgtcgcatgcacgatggtaccggtcgtgctcgcttacacgatttggagttactacgtcttccggaaacgggttacaccgcatgaattgcattattaaaaaagttcagggggcgggggttaaagatcgccgtccactgctcacccggggagcggatttcgggcaaaccgggtgttttctttttcattcggcaccgtttggacgggtgcggagagaagcagatcaatacgggaatagggaatggatactactcctggaatggaaccttttggatgggtacggagagaagcagtccgcatattgcggattgaagcaggaacctggcacgatcttagggactccgtacaggtgaaaatatgccaatgaacgaatcaaaaaagccctgcgtatggcggaatggccccataccggagaggagctggtgcggatggataaacatctgatgcagtataaaggcagcttaaaaacttttatcattgccggatgcctgacgatgatccaatcggttgctattatcgtgcaggcagtatacctggcaaaagcgattgtccatttatacaaaggggtgccgtggcaggaagcagcggctgaatttggcatctttttcgccgcccatctcatccgccactttttgcagtgggcaaagtcgcgggttgcgttccggtttgccggccgcacgtccctccattaccaaaacttgctcgttgaaaagctgtttcgcatcggaccgcgcgccatcagcaggcatggcacgggcaatctggtgacgctttgccttgagggcattccggagttccgtacttatttagagctttttattccacggtttatcgcgtgcctgacgatcccggctgttctccttgtgtatattttttcacaggatgttgaaaccgggatcacgctgctggttgtcatgccgattttaatcgggtttttgattctgctcgggctcgccgcgcaaaagcagaaagaagcgagatgggaaacgtaccagctgctttcccgccattttgtggactcgttaagggggctcgtgacgctgaaatttttagggcggagcaaaagccataaagaagccatttgggaagtcagcaacaagtaccggattgccacaaaccgcacgctcaggattgcttttttatcgtcgttttccctagacttttttgcgactttgtccgtggcggtcgtggccgtggaactcgggctccggctgattaacgggcaaatcggatttgaaccggcccttgcgcttttaattctcgcgccggagtattttatgccggtccgcgatcttggcagcgattaccatgccacgatgaacggcaaagaagcgggcgagaagatccaccgcctgcttgccgaaaaagaagactttggaaacgggctttcttttcccgtcccggtttggaacgaacacagtacattaacagtggaagggctcgaaaaacagtcgccggaagaaaaccgggcgatcttgcaagatgtcacgtttaccgcccgcgggtttcaaaaaatcggtgtgatcggaatctccggttcgggcaaatcgacgctgattgacctgttatccgggttctccatgccggatggcggacggatcaggattgacggcctggaagttccgcatttgtcctttacagaatggcaaaagcaggtgaactacattccgcagcatccgtatatttttgcaaagaccgtacgggaaaatattgcctggtatgcgccggatgcgccgcttgaaaagattgaggaagcggcccggacagcagggctttccgacctcatcgccagctttccgaacgggcttgatgaaaaaatcggccagggcggacgggtgctaagcggcggtgaagaacagcggattgcgcttgcgcgggcattgctggatgcacgtccggttatgcttttggatgagccgactgcgcatctcgatatcgaaacggaacaggaaattaaacagctgatgctcccgctttttgaacgtaaacttgtcttttttgccacccaccgcctgcactgggtaaaagaaatggatttgattttggtgatggatggcggcaggcttagagaagcgggcacatacgatgagctgtaccggaaaaagggcgccttttacgaacttgtcgaggcgcagcggggaggggtagaacatggcatacttcaaccggtatattaaaccgtatatccgccagtaccggtggctgatggcagctactgtcctgcttggcattattgcttttcttgcttcatcgatgctcacctttacgtccgggtatttgatcacaagggcttcggaaatgccggtgacgattcttttgatttatgtcccgatcgtcggcgtgcgcgctttcgggatcgcgcggccggtcgcccgttattttgagcgacttagcgggcataatacggtgttgaagattcttgctgatatgcgcgtcaaactgtatgaaatgctcgaaccgcaggcgctgtttatccgctcgcgttttcaggcgggggatctgctcggcacgcttgccgatgacatcgagcacttgcaggacgcttatatccgcaccatttttcctgtcgtgacggcgctgtttttgtttttatattctgtttgcacgctggctgcatttgactggcagtttgcgttatggattgccttattaatggggatcgtcctgtttgtttacccgcttttatccttatatttcatgaaaaaacgacaaatcgcgctgaaagaaacacagagccggctgtaccgcaacgtcacggatactttattcggcatccgcgactggatcatcagcggaaagaaagaacggtttttcaagcagtttcatgaagacagccaggaaagccacgaaatggaaaggaagatgtccttttggaatcataaccggaactttcagctacaggtcatctcgggcatgattttaatattgaccggcatctgggcagggcatgccgcaatgcatggagacatcgccccgacctatattgcgtcttttacacttgtaacccttccgattctggaaggcatcatcccggcatccgtggcggtggaaaagattccggcatacaaggaatccctgcaacggattgacgcgatccggcagtacgtcccggataaaagcaggaatagcgcagttcctggagagaaagcggatatccgtttggaacatgtcttttactattatgaaaacgaaccggccgcagctttgaacgatgtgtcactcaccattccccatgggcaaaaaatcgcggtgcttggcaaaagcggagcgggcaaatcgacgcttctccatctgctgattggggcgctgcagcctgcttcagggaccgtttccatcggcgggcatgccccggcagcatatggcgaagggattcaccagctggtcagtgtcttgaaccagaaaccttatctgttcgcgacaacggtcgaaaataacgctgccctcggacgccccggcgccacatcagaagaaatagaggaggccatccggcaagtcaaacttgaccggtatctccactcccttccaaatgggatccatacccaaatggaggaaaccggccagcgtttttcgggaggcgagcggcaaagaatcgccctcgcacggatcctgctgcaaaatacgcctgtggtcattttggatgaaccgactgtcgggcttgatcccctgacagagaaagacctgctcgatacgatgtttgaagttttaaaagacaaaacggtgattttcattactcaccatctggccgggatggaaaaaatggatcagatcgtctttctggatgaaggaaaaatcgccatgcagggcacacacgcggcattgatggaaaaccatgcgcgttaccgcaaactttatcaactggaccgcggggacgcttgaccagcccccgctttttccagtgccactgttgcagcatgggcgcctgcaagtgaatttgccgttttttatttctgcccgtgccgcgaaagaagcagatgggttatctatcgccggttgcaaaaaatagacacaatttttgaaagcgttaccattgctttcttctttacaaaccattacactgaagatgaaccgaatttggaaagggtggcgccagtgcaaacatttgatttcacaggaaaagttgcaatcgtaaccggcggcgggggaggaatcggccgcgaagcatgcttgaaactggctgcgggcggagcaaatgtcgtggtcgctgatttatctgatgaattgggagaagaaacggctggaaaaatccgtgaaaatggtggggaagcgatttttgtccggaccgatgtttccaaatccaaagatgtccaacattacgtccgaactgcgctagatacttatggaaaaattgatattcttttaaacaatgctggttgggaaggaaagatgaaaccgctcatagattatcccgaagaagtatttgataaactgatgggcattaatgtacgcggcgtctttcttggtatgaagtatgtgttgccgcatatgatcagccaaaaaagcggcaccattgtcaatacggcttctgttgccggcctcgtcggcacaccggaaatggtggcatacggcgccagtaagcatgcggtgatcggcatgacgaaaacggcaggaattgaggcagctccgtccggcgtccgtgtcaatgcggtatgtccaggggttgtggacacagaaatgatgagaaaaattgaaagcggttttgccggaggtgattcagcagctgctgaacaaacgaggcagcaaatggctgcatccgccccgactggccgctatacacaaccggaagaagtggcgaatgttctgctctatcttgcatcagacctgtcttcccatatcattgggcaaacggttgtcattgatggcggggcagtcctttcctaaagtccggctgtaatatctattataagaaataacaatttcgataaatggagggaagctcccgggtataccgtctgcagtataacgcctggctgtacagcgtaaacaagttgatttggcttccctccgtaaagctgaaaaaatatataaaataaataaaatctctcagctctgttgcctgctgcaaaaagtatcgtcatgcaaatcggtgcccaggcttgatgtaaaaactcaagttcattttatatagaataagagggggagtatgcccgggcagcatgaaaatggaaaaatttttacgcgcatataaaacgggactgcccggatggacagtcctcagttacgctgttagtgaatgtctttcttcttaaatctgccgccgcgcacttctgatatgtttccaaccgcgataaaggcgcttttgtcaaattcttctacaatcgatttcaattttgcttcctcaaggcgggtgatgacgcagaaaatgacttttttattgtctccggtataagcgccttccccgtttagataggttaccccgcggccgaggcgggccatgatcgcatcaccgatgtcatacatctcgtcgctgatgatccataccgatttggattcatccagcccctgtacaaccacgtcgattgcttttgtggcgataaaataggtaatgaccgaatacatagcatatttccagctgaacacaaagccggcacaggtaaaaatgaagagattgagaccgagtatgatttcaccgacagagaaaggaagctttttgtttaatagaatggcaagcgcttctgttccgtcaaggcagccaccccagcggatgacaaggccgacgccgatgccaaggataataccgccaaaaaccgtacacagcagcaaatcatccgtaaacacttttacaggggtcagcaggatggttgtcaccgacatgatggagatgccgtaaagggtggtcaaggcaaaagttttcccgatttgcttgtacccgatataaaagaatgggagatttaagatgaaaataactggccccagtttccagccggcaaggtgggaaaggataatcgagatgccggtgatgccgccgtccagaatctggttcgggacaaggaacagctcgagggcaacccccataatcatcgcgccgaggctgacaaagataaaacgctggccaagtaccgcccacttatttttcttctgcctgaattgggcatatgtttttgccgtttcttccatattttatcccctttccaaatgtttttgtgaaaaaatgtacattttacgcatacataagccgttcctttaagagcggggttttccaaagccaaggatttttccctgaaccggagaacgaaaaaatatttacaatgaaggacgctcccgatcaaacagatgagaaaaagcggtataaatatctataatataattatattataagaaagttaaaaagtgaatgaatatgcatttccatgttgtttaaatttttcccggccgttttgaatcatggggaagggcgcgcttttaggggcccaaattgcccgtattgaccgcgaaaatgtttataaaaaaagcccggctcggccgggcttttcaaatatccaatctattctttttccaaggcggcttttaaagcatctgccaggctgttgccgaaactttcctctttctttgtgtatttttgcagcaatttcttttcttcatgttttgacaaagtttttttcttttcgtctgctttttggacaatattgcagtggcggcactggaaatagacgccggatttgccgtgatgaatctccatctttttatggcaggtcgggcagcgcctatttgatagtttcgggcttttccgctttgtaaaccggcattcccggtttgaacagacaagctttttcccgtcttttccgtttacttctttcataagggaaccgcattccgggcattttgttcccgttaaattgtgggcgcggtattttttgtcactcgtccggatttcacggacgaggcgtacggtttcccggcggatggtttccaaaaactgcttcgggttgccttttccgcgggcaattgcttcaagctgttcttcccatttggcggtgagttccggcgattttagctcgtcattgacaaggtcgatcagttgcttgcctttcggggtcggcacaaggcggccggactcacggctgatcgtttcggaggagacgagccgttcaatgatatcggcgcgtgttgccggcgtcccgagtccgtatttttccattctcgaaagaatatccgcttcggaataccgtttcggtgcttcggttaaatgctggctgagccggatttgttccagcttaaatttttttccttctttgatcgaaagcagcgtcgtattttcccgctcctgttcatggtgcaaaacagcggtaaaaccggcatttttcacggccattgtccgcccggtcatggtttttccgcctgcttgaagtttaaattggacggtttcatattcataaaccagatagaatagcgcaaggaaccgttttacgatcagatcatagattttccgttcatcggcagacaaatctgataaggccgggcgttcatctgttggaataatcgcatggtggtccgtcaccttcgcatcattgatgacacgtttggccagtattttacctttccgggaaaggaccggctgaacttcttctttgtatgcatctttcaccgcaagcagccggtcgtacatcgtattttccatatctttcgtcaaatatttcgaatcggtgcgcgggtaggtaacgagtttatgctgttcatataagttttgcagcacgttcaatgttttttttgctgtaaaaccaaaacggtggttggcatcgcgttgcagttccgtcaaatcgtaagggagcggctgctgctcttgcttctgtttgcggatcacctctgtcacgacggcagtctgcccggataaagccgcatgtatggcatttgctttttgctcgtcaaatatccgtttttcgccatgctggtcatacgatacttcgagttttccggcgagcgcttcaatggtccagtattttttcggcacaaaagactggatttcccgttcgcgctcgagcaccatcgccaatgtcggcgtctgcacgcgcccggcggagagcggatcgttgtatttcacggttaaagcacgggagacgttcaatccgatcagccagtctgcttcgctgcggcaaacggcggagtggtacagattgtcatactgctttgccggttttaactgtttgaatccgtctttaatcgctttatcggtctgggaagaaatccataaccgtttcaccggttttttccagcgcattttttccagaatccagcgtgcgacaagttcgccttcgcgcccggcatcggttgcgataatgcagtctttgatgtcgcttcttttgccaagctgttcgatcgctttatattgcggataggtctgccggattgttttaatttccattttatccggaagaatcggcaggtcttccatacgccattctttatatttcggatgataatcttccggcattttcagttcgatcaaatggccgagcgcccatgtcacgatatagcgcggcccctcaatataacgttttttattttccgtgcagccgaggacgcgcgcaagttcgcgcccgacgctcggcttttcggcgagtacaagcgatttcattgcataacacctttcttttattcctgtctgaacaagtataacgcatcaaacaggattgataaatcatttcgtttcttctgttttcacagtgaaaattttgaaatacaaacgggcttttggtaaaattgtggtttgtaagagacagtgtaacctgaaagcctgcattatatcttgcaaatataattggataggtggttatcaataatggaacaaacaaagccgtacagagtcttattgtattacaagtatgttgaaattgaaaatccggaagcctttgcagccgagcatttgcagttctgcaaagagaccggtttaaaggggcgtatcctcgttgccaaagaagggatcaatggcaccgtttccggaacggttgaacaaacaaccaaatataaagaaaagatgcacgccgatccccggttccgggacatggtctttaaagaagatgaagcagatggccatgcgtttaaaaaaatgcacgtccgcccgcgcaaggaacttgttacgctgcggcttgaaaaagatatcaatccgaatgaaaaaacgggaaaatatttatccccgaaagaatttcgcgaggcgctgctggctgaagataccgttgtactggatgcgcgcaatgattatgagtatgatctcggccatttccgcggagcattgcgtccggatatccgcactttccgcgaactgccgggatgggtgcgcgaacataaagatcaattaaaaggcaaaagaattgtgacgtattgcacaggcggcatccgctgtgaaaaattttcgggctggcttttggaagaagggtttgaagatgtcggccaactgcacggcgggattgtaacatacggaaaggatccggaagtgcagggcgagctgtgggacggcaaactgtatgtattcgacgaacggatttccgttccggtcaatcgaaaagaacatgtcgttgtcggccgggattattttacgggggaaccgtgcgaacgttatgtcaactgcgccaacccggcctgcaacaagcaaattttatgctcggaagaaaatgaacataaatatatgcggagctgctcgcatgaatgccgtaccgtaccaaataacttatatgtaaaagaacacggccttacaccggaagaagtggctgaacggctgcgccggatcgaagaagaagacgcggcgttaaaccggtaaacggtgcggcttttaaccttactatccgaaaagcggatggtgaaaaagggcatggaaaccgtgctcgctccctgccggaacgattccttgcttcggaaacggcattttcttgaaagaaacaaggcctaaagagcggaatgtgaaaaagagaagaaaaaccgggaactgctgcaaacatcccagctcgggggcagggttaacaagcggtgcgttccggaacagagaaaggatttggtgcaactgggccaaatcctttttatctgcctgttttttgtgtaaaatggggaaaaatgggcatctttgccgcttcatacgcggtatggcagaggatgaaaatcagcgggcaatattttcaggatagaaagaaaggcgggatttggatgtgcgggaggtacacgttaacggcatctgtaaatgaattggaagaaaggttccatgccaaagcttctttttcaagcagtgaatatgccaaaagttataatgtcgcgccttcgcaaatggtggctgccgtgatcagcgcccatgggcagtacagactcggttttttaaaatggggcttgattccttcctgggcaaaagatccgaaaatcgggcataagatgatcaatgccagaagcgaaaccgtatttcagaaaccgggtttccgggaggcagtgaaaaggcggcgctgcctcattccggccgattctttttttgagtggaaccgaaaagacggcacccgggagccgatgcggatcaggcttaagaacaggggcatttttgcgatggccgggctttgggaaaaatggatggaccaggaagggaatccggtctttacttgcacgattttaacgacaaaggcgaacaggatgatggcaaaaattcacgaccggatgccggtgattttacgcagggaagatgaagaaaaatggctggacacatcggtcactgaggcgggccggctgttgccactcctttcgcagtatgatgcagacctaatggaaatgtatgccgtatctgaacgcgtcaattcgccgaaaaacaattttccggagctgttattgccaaaagattaaattttttgttgaaatgttgtggcaaaaagtttatcataaaggtgacaatttcatgaacgtaaccacagggggagcgttaagctgagagtgaacgccatgttctgaccctttgaacctgtccggttaatgccggcgtagggatgtggaatttcttttgtcctcccatggttcgttatgttcatgcataccaaaagggggatttttttatgggcaaattaagtttacaggctatgattgaagcggctatttttgcggcgttcgcgctcgtgttggacttattgccgtccattaaggtgacgtccgcgatttctctgtcgtttgccatgctgccgatttttgtggtcgcttttcgctggggatttaaagcaagtgttgcttccggatttatttggagcctgctgcagatcgtcaccggtgatgctaatgatattcttaacccgcttcagggcatcatggaatatccggtcgctttttcgttcatcgggttttccgggcttttccggccgcttgtcgaaagaagctgtcgtcacgataaaaagggcacgatgactttttggatatgcctttccgttcttaccggaagttttgcccgctatttctggcatttcgtagccggcgtgattttttggggttcctatgcgcctaaaggacagtcggcgtttctctattctctcatcatgaacggcggcacgatgattgggaatgcgattttatgcgcagctgttgcggcgattctcttgaatgccgccccgcagctgctgacaaaataccgcaatccgcacaggcatgcggcataaaagcaacttgaaaacggcaaggccaactgcgccttgccgttttcgctgaaggaaagaggcttcatggtaacaggcgccttgtaaagccggtagtccggtttttactgctttttcggttgatgataggaggctacgggtaaggctttcgagaaacgggaaaagataaatagaaggaaaatgaaagaaaggggattttatggacaaagacattcatcacccgtttggccaccgggtcatcccgatgacttcgattgagagcggaacaggcagggaattgctgccggatatctattgccttaccatccaaattgtcaatgtgtgcctgatcggcagggccggaaccgatgcatttgtcctcgtggatgccggcatgccgggttctgccgaagcgatattttcagccgtgcgggcacgcttcggggaaaaggcaaaaccaaaagcggttttactgacgctcggccattttgaccatgtcggagcgattgcgccattattggaaaagtgggacgtgccggtttttgcacatcgattggagttgccctatttaaccgggcgtgaaacgtatccggatcccgatccgtccgttgaaggcggcctgctggcgaagatttccatgatttatccgaatgaaccggttgatcttggccatgctgtccagccccttcccgaagacgggacggtcccgtttttgccgggctggaaatggatccatacgcccggccattcgagagggcatgtgtcgttcttcagggaagcagacagcgtgttgatcatgggggacgcatttatcaccgtcaggcaggatgaattttggaaagtgctggtgcaaaggcaggaagtaaacgggccgccgcgctattttacaaatgactggaaagcggccaaacgctcagttgaaaaattagctgctttaaagccggaaactgctgtttgcggccacgggatcccgatgtctggctccggcttgcggaaagggcttgaggaccttgcatccagatttgatgaaatcgcgctcccggatcacgggaaatacgtagatggcacacaataggcggtttgttcattgcttccttccccgcaaaggtttacaataatttgtaaatggatggatataaaggggtgagaaaattggaagtcaaagattttatgatccgggatgttattacggtaaaaaaagagacaacgatccgggaactgttaaaggtgcttgcccaccaccggatcggcggcgtaccggtcgtggacgcggaaggaaagctactcggtatgatcagcgacggggatgtcatccgctttttgcagccaaaagcacggaccgtttacgatttttatattacgatcgtggtaaatgagcaggaagactttaatgaaaaattggtgcacagcctggacttcccggtggaaaagattatgaaacggcgggaactgtatacggtaaggcctgaagacgattttgaaaatgcgctcaggattctggtaaaacaccattttaaaaagcttccggtcgtcaatcaggcagggcgtgttgtcggcgtcatctcaagaggcgatatcatgcgccagattacggataaattgctcaacagctaaatcgcaatgtttagaccggcctccccggggaagactatacataacagtctttcggggaggtcaaatcatgaacggaacttcaatgccgcaatctcctgaaccgttgtggcgcaaaacggtcacgatgccgcaatttccatcgttaacgcaggatatggaagccgatgtggccgttgtgggtgccggaatggccgggattgtaactacctatttgctggcaaacgaagggtataaaacgatcctgtttgatgccggatccattgcaaatggcacaagcgggcatacgacggcaaaaatcaccgcacagcacgggctcatttatgatgaattgatccagcatataggaaaagaaaaagcatccctttattacaaagcaaacgaaacagctgcatcgttcattgaacaaacgatcctgaagcacgggatccgctgtgatttttcgcggcaggatgcctttctctataccaattccgatgcatatattgaaaaactggaaaaagaaatgcaggcgtatgaaaccctcggcatcccgggagaatggatcggttcgctgccggacgggattcccgggaaaaaagcggtgaaaatggccgggcaggcacagttccatccgctttcgtacttaaaagcactgattgaatatttaatggacaaaaatgtcccgatttttgaacaaaccactgcgaaagatatcgattttggcagcccattaaaaatcaaaacggaaaaagggcataccatgacgtgcaaatacatttgcatctgtacacactatcctttttacaatgcgaaaggcttgtatttctcaagaatgtatccggaacgttcgtacttgcttgccgtgaaacctgtaaaaccttttccgggcggcatgtacattaatgcggagcagccgtcgcgttcattccgggaagcggaaggagccggggaaaaactgcttttggtcggcggagagaaccataaaaccggccatggggaaccggagatccgccactatgaagcattgcagcaatttgcagaagaaacattcggaataggggcattctgctgtcgctggtcagcccaggatatgaccacattagataaaatcccttatatcggccccattaccaaaaatgaagaaagggtcatggtcgcaacagggttccgcaaatgggggatgaccggcacccatctcgccgccatgctgatgcgggaccggattatgcaaaaagaaaatccttatgccggtatcttttccccgcagcgttttgaagcggatccgatggtcaaaaaatttatctcggcaaatgtcgatgttgccgggcagctcgtcaaaggaaaacttgacatgcggaatcaatctttagatgcgttaaaaaatgacgaaggggccgttgtccgtatcaatggaaagcgggcaggcgcctacaaagaccaggacgggaacatctatctgcttgatacgacgtgtacccatatgggctgtgaagtgaaatggaactcgggagaccgcacatgggactgcccgtgccacggttcgcggtttgcttgtacaggcgaagtggtagaagggccggcgaaagaaccgctgaaaaaaatcgatcaacaggactaaagtgctgcaaacaccgccgcaattcgacggtgtttttctgcttctatgcgcgaattcgtgactttatgcctatgttacaaatttttcacgggattacaaagaagcgtttttgtgtaaccaaatcaacattttgccgttatccgcctgttaaatccgtgtgttaggatttacggtgttggcacaaaagccggcaaaaagaggaggttacaatttatgaaaaaagcagtatcagcacttgcagctgcggtgacaatcacaagcgtaatggctgtcaatgcacaagccgcagcgccggatacttataccgtaaaaccgggggatacactttgggggatctctcaaaaatacaatacatccgttaaaacattaaaacaaaataaccaactttccaccgaaatgatttatccttcacaaaagttaaccatttccccgaaaaacgtttatgtcattaaagccggtgacacgctgtcggatatctcgaaaaaatacggcgtgccggttgaacaaataaaagaatggaacgatctgtcatcggatgtcattttcccgcatgatcaaatcgtgattcgttccaatccgaacagcaaagtgacagtaaaagaacgtgcagcggaagtttccgtccagccgcaaacaaacacggaaaatgcaaaagtggacgtgaaaaagccgaccgtgcacgtggaatcttccaaagaggcggctccaaaaccgcagggaaaaacgatgaccgtcaccgcgaccgcttatacagccaatgatccgggctgctccggcgttacagcgaccggcatcaatgttaaaaataatccaaacgcaaaagtgattgccgtcgatccgaacgtgattccgctcggttcaaaagtatatgtcgaagggtacgggaccgctgttgcaggtgatacgggcggcgccattaaaggaaaccgtatcgatgtcctcgtcccggattcaggaaaagccgccaactgggggcgccgtacgatccaaatcaccgtgctgaattaatgggcgcacggatggtgatccggtacttgcacccgaaacattcaacaggcacagcaaaacagaaaacaaccatttaggaagtgacaatgaacgatgggggaaataccgcattttgaaacaccgcccggccgcgtaaatccagtggaaaaggatttacccggccgggcgtttattttttcttggcagcgtgtgaaaaacattgtaaagtagagctagaaaaagaaaggagtgatctgtttgtcttttcctttgatcatcgctgaaaaacctgaccaggggcgcaccctttgttcggtttttccgcatgtgaaacgggaggggtatattgaaatccggccgaatgagatcttcccggaaggcgctttctgcacatgggcgatcggccatttaacccagctcgtcccgccggaacattacaatcccgcctgggagcagtggaaactggaaacgctgccgattctcccggaaacattcaaatatgaagtggcaaagtcaaaatacaatcaatttcaaatcgtcaaaaaactggtaaaagacgcgcgtgtaacaaatattattcatgcaggcgatgccggccgcgaaggggaactgatcatccgcaacatccttcatttgtgcggcgccaaaaaaccgctccggcgtctatggatctcgtctttaaccccgcagtcgatccgggaagggttccgccatttattacatgatgaagacacccgccctttgtatgatgaagcatacgcccgcgcttgtgcagactggctggttggcatgaacgcctcccgtgtctacagcctgcttttaaggcaaaaaggcatgcgcgatgtcttttcggtcggtcgcgtccagacacctacgctcgctttaatcgtaaaaagggagctggaaattgaacattttaaacccgaaccgttttgggaagtcaccgcaatgtttcaatttgatgacaaacaatacgaaggcaaatgggtgaaagatggcgaatcgcgtttgaatgacccggccatggcagcacggattgccgcattttgccgccaaaaaccggcggaagttgcagaattgaaaaaagaaaaaaaggaattccagcctccgctgttgtttaacttgtcatctttgcaggcagccgcgaacagggcttttcaatttccaccgaaaaaaacgcttgatcttgtccaatccctctaccaaaaagggatcgtttcctatccccgttccgattcccaatacgtgacaaaaggggaagccgaaacttttcccggtattttggaaaaactatccgcctgcccggaatatgctccgtatttcccgcttccaaagcgttccatccttcaaaataagcgttatgtaaatgagaaaaaggtttccgaccactacgcgataattccgaccgaacaggttgtggcaccaggcagtcttccggacggtgagaaaaaaatttatgatatgatcgtccgccgccttattgctgcccattacggcaatgccgtttttcattacacgacggtgaaaacggtcgtggatagccgtgcaacatttctttccaagggcacgcaaatggaagcggaaggctggcgcaaagtcattttttcgaaagaaaaggaaaaagatggaattttgccggatgtaaagcagggggaaaaaggggttgtcatcgatacaaacgtcaaagaaggcaaaacgcagccgccgaaacggtacacggaaggccagctcatcacgctgatgaaaacggccggaaaatatattgaggatagggaactagaaaaagtcatggcggaagtggaagggctcggtacggaagcaacaagggccggcgtcatcaccattttaaaagaccggaagtatattgaggtgaaaaagaatcaggtctatgccactgataaagcgaaagtgctcatccgtgccattggcggcaaaattctggcttctccggaaatgactgcaaaatgggaaaaacggctccgcgaaatcgggaggggggcggcagaagcagccgcttttatggaacagacgaaaaagctgtccagaaaaattgtgcaagatgctgttcaggcagcggccgaatgggatttttccggcttaaaaacggatgacattaaaaggccggaatcaaaatataccatcgggaaaaaagccggcaaatgcccggtatgcggcggcgtcattgtggacaagggcgatttttacggttgcagtgcctatcggaaatcaggctgcacctttacgctgtcaaaatcgatccttggcaagaaaatcagcctggccaatgtaaggaaactgctggccggtgaagaaacaaacatgatcaagggattccgaaaaaatggcaaaatctttgatgcaaaattgaaatgggaggacgggaaactccggtttatttttgcaaagcaacaaaccggccgttgattattcaggggccggtttgtgcgaagcttgttttttctttcggctcacgaaaacggcaatggcaatgatgatcaccatgacgatgaaactggcataaaacccggggcgaatttctttttccgccagtgtcccgctgatcgcaagcagcaggaaaaggataccggctatggccgtgatttttccgccgccgtttagttttaagacgcgaaaagccgaaaggataataaatagccagttcatcagcagcaaaatcccggctgctgttgtaatgtattcataaattttccccggcagcaaaagggctgtaataatggaaagaaccaggccgcaagccgcaagcccgagcgaaggaagcggaaggtttttccatttttttatttttttgccgaaccattttggcgcatccccgtcattcgacaaggttacgagcaaattggtaaccccgaacagcgcggccgtcatcgtcgaaaatccggcaatgataatggcgccgttaaagacgtgggggaaaaaggtgagatgatagtccgccattgccttgacaaacggactttctttatcattaaaagccgtatagtgttccattgtgacggcaagcccgagcgagaccacgtaaatcatcgttagaacgactagcatgatcgatccggctttcggcgcatcttctttgtttttcaattgcatcgccatcagcccgatcacttcaatgccgccaaacgcataaaacgcataaatgagcgaagcccaaaagcctaacgcgccatggggaaaatagccgtggagaccattagggaggaacccgcccgttccccgcccgccgtcaatccaaccaaaaagggcacaaaaggcaagcaaaataaacatgatgatggcggccgttttgatgacagcgagaatattttccaccttatcaaaaccttttgtgccaagcaggacaacaacaatggaaagggctgcgtaaatggcggccagtatccataacggcaccgtatgaaaccagaattttgttaaaatggacaatgcggtcagctggctccccataataagcacattcgaacaccagtaattccagccgcagctgaatcctgcccagttgccgtaagctttttttgcataataacaaaacgagccttcgtgtgggtcgcgtgccgtcattttcgcaagcgcgcggaaaacaatatatgtaccggcggccgcaatcaggaatgacaacacgaaagaagggcctgtcgttttgatcccgatacccgatccgagaaaatagccggttccgatcgtacagccgacaccgacaagcgaaagctgccaccatgtcaggttgccgttttttgtcgctttagatggttgcttctggttgcccatcccggttccctcctttaccttacatactgtttgataaagcaggccggtttatgtacaagtccttgatgcttcttaagacagaagcgttttgatcccctgcacgccgaaatacaggccgaatccgattaaagacgcgccggaagcgagggaaatgatttgcagtgtccggtgattgaaatagcgccggaatccgcccgtcaaaccggcgatgaacacatcccagatggcaagtcccacaaaaatcatgctgctgtatgccagcaacatgcccgtcccgtaatggccggcggttttggcaaggacagacccgtatatgccaagccagaacaaaatggataaaggacttgtgatcgacatgataaatcctgttaaaaagcatgcggcaagcggatctttcttccggtataaatcaacggtgatcgtttttgagctgattacactttccacgccggtataaatgaggataaatccgccaaacagccagagaaagacctgcaccatttcaatatttaaaaaccggacaagccccaagtacactgccgccataaaaatgccgtccgcgatcatcgacccggtcccgaccatccacgcatgccaaaaaccgtttttaatgcctttgtcaatgcgcgcggaattgaccggcccgatcggcgcagccaaagaaagcccgagaaacacatagccggcaaaaaggccgatgtccacatcccccactcctcccgaggaaaacttgtacattttatgcacgggcttgccttttcatgtatgccatgccttgacaaagcgtgttacccgttcgcttttccgccaccaacagtgaaaacctaaaaggaagagaaacgtttgatacagcaggcaagcgggaataaaaaagggaagagaaagggggaagacgtttgttacatctgtataaaaacaaggaaaacaactggaaatggtatcagctggaaagtgcggatgagaaagaaatcgcacggattattgatgaaaacgaggaatgcaaaacatggattaaaaatataaaaaatgatgatacaaacactttaaagattgatacaacccaaaatgaccggccgtttgtcgaaggctcgcttatttttgaccagcacacgatcaaccgtgaggaacatgatatgtttcacttttacatcaccgaaaaaacgctgttgacggtagatcttgatttttccaagctgaaaaatacggaaatcgaaaaagtcatcgggcagatggcctattcccgcaatgccattgaggcattttttattatcatcggcgcgatcgtaaataattacctagataaaatagacgaatttgaaattaaattaaacgaactgatctgggagatccaaaaaaggaacaatattgacacgctcgataaaatatacgaacgccgccacgaactgctcgtctgccggaatttgatgatcccggtgaaagagatattatacggcatgcaggaaggatttggcactgatattttggaatacccgcaagtccggcaaagggtcatgaaaatcgaaagatgccttgcgcttttgcaggattaccaacaggaaatcgatacgctgctcaaagtggaagaagtggtttcaggccacaggggaaattcgattatgaaaactctgaccgttttaatgacgctgtttaccccgatttccgcctggagcgccttatggggcatgaactttaaaaacatgccggaactctcctggcgctacggctatattgcagcgctcggcctgattgtcgtaaataccatcctgctttatatctatttgtaccggaaaggatggacaggcgatattttaaaagggaataagaaaaaatcattatttaaatagcccttgctgaacgaatccgattctgagtttgtacccaatttgtcagtaagttctagaagaatccatctttaaaaatacgattctgtcttctctatacattgaatcagctttcaagtgcaagcttttctctggatttttataacacccttgcatctaaatttttgccaaagctgtcagcatccttgccagatctaggaattttggttatttttgcaagccctatgttaagaaagcctggaaaattgacggcctttcttcacataggactcgtctacgttaaggaagcaagcaaaaacgaggctcttccttgacatagagcccgtctatgttaaggaagcgtggaaaattggtggccttccttaacatagggcgcatctacgttaaggaagcacgaaaaaacgaggctcttccttcacatagagcgcgtatatgttaaggaagcgcgaaaaattgacggcctttcttcacatagagcgcgtctacgttaagaaagcgtgaaaaaacgagggttttccttcatatagagcctgtctacgttaaggaagcgtggaaaattggtggccttccttaacatagggtgcgtttcaagtgcaagcttttccctgtattctttataaaacccttgtattaaatttatgccaaagctgtcagcatccttgccaaatctaggaattttgctaattcagcaagccctaaatagcccttttccggctcgggaccgccagcttttttgcgcccgtttcattgatgtgaaagccaaattcctgtatgttaaaaacaaagaaaaaatttcaaaaggagcgtttccaatgaaagtgtacggcccggtggtagatgatgagacgcgctgcatccattatgcttctccgttggatgtcgtagccatccgttttaaatgctgcggaaagtattatccgtgttatcaatgccatgaggaagcggaagcccatccgatcgagcggtgggaaaaacgggaatgggatacaaaagcggttctttgcggtgtctgcaagcatgaaatgacgatccgggaatatatgggggcaagcgcttgcccgcattgcggcgcgccatttaaccccggatgcgccgcccattatccgctctatttccaaatcgaccgggacaagccggcttgtcaaaaattttcaccttgaccgcttttctgaaatatggtatcttaaatgcaatcaaatcctttagtgtattagagtactaacataataaagagaaagtacaggatgtgaaaccgatgtttttaccggaaggcagccaggatgaaatgggcacggttgtcaaaaaccgcgcaaccgtgtttgaaatgttccgtcgcacggcggagaagcggaattatacggaaatctcgacaccgcttgttgagtacgcggatacgtttacaaatgaaaaggttggcatgaagcttcaaaatatgctgaaatggtttgatggccgcggccagattgaagttttgcgcccggactggaccacctccatcgcaagggcgctttcgcaaaaaccgttccgggcgtgtaaatgggcttaccagggttcagtgttcagaatggatacccccggccttgagaaccgccaggtcgggatcgaaatggtggacctgccggaacttttaggcgaaggcgaatgcctgttttttgcccatgacttttttaacaggcttggcgttaccggggtgatggtggagcttggtcacgccggtatttttgaggaactggtcgcacgcctgaacctggaagacggtcaggttgaccggttaaggggggccatgcacgataaacgaaaagatgaagtattcgagattgcaagtttaagcggcaatgcaaaaattgccgcggaactggcgggacttgtggatgcgtacggctcgttcgaaatgatccggacatttcaggaaagatggaaaacggaaccggcactttcggatatgcttattcatatcgaaaagcttggcaaaatttgcatggctgtcggaatggaagacatcatgattgaccttggccgggtgaaaaatctgccctattataccggcattttgttccggggatttttaaaacaaaccggcgcttcctgcttttctggcgggcggtacgacatgctgtacgaacagtttcaccgccaaacaacagctgtcggcattgcttttgatgccgatatgctggcagaggaactggctcaggaagaaaaaccggaaaaaatctgcatcattgccggggaagaaacgcttgcggaagcagaaaagctgcgagctgcatacggcggaaaaatcgtggatatccgtttcgcgccgcctgcagaaggcgaattcaataaggttctcaagtttaaaaacgtgagcggccattgggaggcggaagaaatttgacgatcagcattgcccttacaaaagggagagtggaaaaacaatttttgcaatatttaaagtcgcgcggctttcatgttgaaccgctcgttgaaaaagggagaaaactcctcgttgaaacggatgcattcacctgcattttcgtaaaaggctttgatgttgcaacatatgtagagtacggcatttgcgatcttggcattgtcggggaggacattttggcggaaacgcatcccgatgttttcgatttaatgccgcttccgttcgggaaatgccggtttgcccttgcaggtaaaccggaggctgtccgccatcagcggaaacgccggatcgcaaccaaatacccaaatgtgaccgagcaatttttccgcgaaaaaggggaatctgtggacatcgtgaaactcgaaggctccgttgaactcgcgccgatcgttggccttgctgatgcaattgtcgacatcgtggaaacgggtaacacattgagagaaaacgggcttaccgtcatagaggagattcagccggtcacagcgcggctgatcgccaaccggtcggcgttaaaaataaaaaagcaggcaatctggccgtttattgaaaaactacagggagaaggggtcgcaaaatgatacgggaatacacaaaagaagcatttgccgaaacgtttttgcaatcgaaaaacaagagcggcgtgcatgatgaaggcgtgctgcgcaccgcgaaggaagtgctggaagacattcgcttaaatggggatgccgccgtgaaaaaatataccgccaaatttgacggggaagtgccggaatcgtgggaagttttaccggaagaacgcaaacaggcatggcacgaagtcccgcaagatgtgatttccgccttgcaaaaagcagcggaaaatattcgccgtttccacgcgaaacagctgcaaaactcccggatcatggaaatgaatgaaaacatcatttcaggccagctgtttcggccagtggaaaaagccgggatttatgtgccgggcgggactgcctgctatccgtcatccgttctcatgaacgcaatcccagctgtccttgccggcgtggaagaagtgatcatggcgacaccggcgagaaacggcacgaaaattgcaccggttttatccgtagcggccgatattgccggtgtcgggaccatttacaaacttggcggcatccaggcgatcggggcgcttgcatacggcacggaaacgattcctaaagtcgataaaattgttggccctgggaacgcatatgtcgctgccgccaaatcgctcgtatatggcacggtcggcatcgacatgatcgcaggcccgtcggaagtcgccatcattgccgatgaaaatgctaatccagtatatatagcagccgatctgatcgcccaggccgaacacgacgaacgtgcaagaacgtttttgttcaccacctcacagaaactgatcaatgaaacaaagtcggcacttgaaaaacagcttgttgtcctcccacgccgcgacatcggggaagtgtccatcaagatgcaaagtgcagccgtgcttgttgaatcgatagatgaagcctttgcactttcgaaccggcttgcgccagaacatttggaaatccaggtggaaaatccgctcttgcagctctcaaaagtgaaaaatgccggctccgtttttctcggagaaaacacgccggaagccatcggcgattattacggcggcccgaaccacatcctgccgacatcgggaacggcgcggttttcttccggtttgtctgttgacgatttttataaaaaaattacgtatttatattatggtgaaaaagctttacagcaagcggcgccggatgtgatggcgattgctacggaagagcagctcgccgggcatgcgcgggcggtccaaaaacgggtgaaagggtgagtgcgttgcggaaagcggcaaaaagcagaaaaacaaatgaaacatgtattgagattgccgtcaatctggacgatccggcggaagtgaaagtggagacgggtgttggattttttgaccatatgctcgaactgttcgcgcggcacgggcgcatcggacttgttgtaaaagcggaaggcgatttgcatattgacagccaccataccgtcgaagacacagggattgtgctcggccagctggtacgtgaagcgctcggcgataaaaaaggcatcacccgttacggctccgcttatgtcccgatggatgaagcgctcggctttgtcgccctcgacatcagcggccggcctttcctgcattttgaagcggaatttgaaaacccgaaactcggcaattttgacacagaacttgtgcgcgaatttttccaggcgtttgcgttccaggcggcggttactcttcacgccagggtgctgtacggcgaaaacacccatcacaaaatcgaatcgctgtttaaggcgttgggacgggcgcttcaccaggcagtggaagttgacccggaaatcaaaggcgtcaattcgacaaaggggctgatagaatgatcgcaattgtcgactacggcatgggcaatattgcaagcgcctcgaacgctttccgtacgcttgggcttgaggttgccgtaacggacgacccggaaaaactcgctgccgccacccacatcatcctgcccggcgtcggcgcatttaaagcagcagtggacgaaattgaaaagcgcgggctgcggccggttttaacggagcttgggaagaaaaagccgtttctcggcatttgcctcgggatgcagctgttatttgaaacaggatttgaaaatggtgttgcggaagggctcggctttattccggggacggtggaacggattcagacgaatgaaattttaccgcatatcggctggaatacgctcgatgtgaaaccgggttttccggcttttgcgccgtttcagcatcaacatgtgtatttcgttcactcctaccaggcgaaaacagaggcgccgtatattgtggcttcaaccgattacggggcggaaattccggccattgtcaaaaacgggaatgtgtatgggatgcagtttcatcccgaaaaaagcggcaaaaccggcatggcactgttaaaaatatttttgcaggaaagcagtttggaggtacaggcatgagaattatcccggctatcgatttaattggcggaaaatgcgtaaggctttaccagggggattttaaccaaacgacagaagtgtcacccgacccggtggcacagctggaacgctttattgaaatgggggcggaaatggtccatattgtcgatttggacggcgcaaagacaggccggccggcacagtttgaactgattgcctctttatgcaagactgccgccgttccagtcgaggtaggcggcggcatccgcaatttggacacagtccatcaatatgcggaaataggcgtttcccggattgtgctcggaacggccgcaatcgaaaaccgggattttttaaaagcggcggtcgccgaatatccggagaaaatcgtcgccggcattgatgcaaaaaacgggaaagtcgcggcacacggctggcttgctgttaccgaaatggattacatcggttttgcaaaagaaatagaaagcctgggcgtttcgcgcatcgtctttaccgatatatcgagggatggcacgatgaaaggcccgaaccttgatgcgttaaaagcgctcattgaagcggtcagctgtgacatcattgcttccggcggcatcacaagcgaacaagacgtgaaaaacctggatgcaatcggcgtcaaggaaggcattgttggcaaagcgatttacgaaggcaaaatccggctcaagggggcggcacgatgatcgcaaaacggattattccgtgcctcgatgtgaaagacgggcaggttgtaaaaggaacaaattttgtcgggctccgcaatgtcggcgatcccgttgagcttgcaacattttattcggaaagcggtgctgatgaactggtttttcttgatattaccgcaacccacgaacagcgcgatacggtcatcaatatggtggaaaggacagctgaaaatgtgtttatcccgtttacggtcggcggcggcgtgcggacgattttcgacgtgacccgcctgttaaaggccggcgccgataaagtgtcggtgaactcggcggcgatcaaaaacccggacctgatccgaaaggcgtccgaccggtttggtgcgcagtgtgtcgtcgtggcgattgatgccaaaaaaactgcggaggggaaatggacttgtgtcgtaaacggtggccgcatcgataccggaatcgatgcgattgaatgggcgaaggaagcagaacggctcggtgccggggaaattttactgacgagcgttgataccgacggggtaaaagacggctttgacctggcgctgacaaaagcggtcgccggtgccgtcaaaattccagtgatcgcatcgggcggttgtggcaaaccggaacattttgccgaagtgttgaaagaaacaggcgcttctgcagcccttgccgcctccatttttcacgatggcacgtttaccatccgggaagtaaaagacatttgcagcaaagaaggggtgaacatccgtgaagcttgatttttcgaaagggctgattccggccattgtggtcgacgatgcgacgggggatgtgctcatgctcgcttatatgaatgaagaagcgtacgaaaaaacgcttgaaacgaaagaaacatggttttattcccggtcccgcggcagcctttggcataaaggcgaaacgagtggaaacacgcaaaaagtaaaatcgctccaggtggattgtgatgccgacacgcttttaatccgtgttgacccggaaggccctgcctgccacacgggggaaaggacatgcttttatacaaggctagatgaaaaaggggaagcggtggaagcggaaattccctccaaccggcgcatctttgacatgctggaagaggagatggaaagccggaaaatcaagccggttgaaaattcctataccaattatttgtttgagaagggcatcgataaaatcgcaaaaaaatttattgaagaagcgggcgaggtcatcatcgctgccaaaaacaacagcaaatcagaactcatttacgaaacagcggatttgttgtttcatacctttgtccttctgtctaaccagaatgtcaaactatcggaagtggaagccgaactgcaggcccgttctgccaaaaaaggcaacagcaaaggcgaccggaaaaaaatcgaaaaatggtaatgaaaaaaggatgtccggataagggacatccttttttcattacttgatgccagcacggcagggttatttacaaacgcggatgtaataatacaacgtcgttccgtctttcactttcgagagcacttcatgcccatgccgtttgcacgacgccggcacgttaataaaagattgcgggcagtcggcgatcacttccaatattttcccgtcttctaatttttcgatggcctcaagcgtataaagctccggatacgggcatgattcgccacggacatccagtgttgcatccacagtaaaattttccgccatttttaccgcctcctgattacgcagacgttttcttttcgaataacgtgcgttttgcgtttatttttttcgtataccaattttcccgccatacgataagaagataaagggccagcagaaaagcgcccgtaccgaaaagcgccccgccccatccgaatgacgtgacaatattgacttccggccatcctttgacaaacacatcgaaaatgccccaatgatcccatccgtatgccaggagggttgccccaacgatattgccggcgccgactgcaaaaaattgcacttgcccctctgtaatgcggtacatccaccctgtttcacaacctccggcaatgacaatgccaatgccaaacaggacgccgccgacaagagcaccagggcttgcccagtggataacaggggcttcgcctttaaatatgaaaatagcggtgcctgccgtctggatcgccattcccacaatgatcgcttttccgagcgttccccgcccggtcagccataaatccctgagcccggaagtaaagcaaatttggccgcgctggatcagtatcccaaatgccgccccgaacagtgcggcaagccccagcattattttaccggatatgagataccaggcggcaatcagcgcaataaaaagcaaaaccaaaacagcagcataaagctggtagttcccgtgttgcggatccggctgtgtgcttttggcagcatgccggctgaacgatatttttggttttcctttaaaaatgggcaatacggcaagtttgacgccaaaataagtaccgatcgcggtgccgacaataaagaaccaggcgtggagagaaaattgcggcagtcccgtaaaaaacgcagccaaattgcagcccatcgcaaggcgcgttccgaatccggcaatgatgccgccaataaaaccccacacccagcgccgtttctggcggggaactttccatttaaaattcttgctggcaagggcactgaacaaactgccaagcagcatgccgatgaccagccatccgtctgtccggtcctgcggctctccgatcagtttgatcgctttaaaatacgcccaatcagccgtatcgacgccgaacagctgaagcaaattccctccccagcgggtaaattcgcctgtgacggcccagagcgttccggtcagcccaaaataaaaagcagcaaacacgcctgccaacagtaagacaataaaaggattccaaaacccgctgaagtacttttcatgggctttttccaaccatatacgcatgcctttccggcctccttcatgaaaaatcatacattccctattatagcagagttttccgtcggcacattgataaaagtaaaggttgtaaagcggtttgctttttcaaatctgaaaataatggtaaaataatgaaacatatcatggggaaaggggggagatggcccggggacggcgtatacctggaccagcgaagcaacaaatgggaaacaatcaaaaaagcggggtgttatacaccttttttgcttattttttgtgggggctttttccgatttactggaaaatgattgagcaggtgcctgctattgaaattctcgcacaccgcattttctggtcttttatttttatgatcatacttttagcctttttaaggaaaatgggtgatttaaaaacgagcataaaagaaggggtccgccacccgcgcacgccgcttttattgcttctcgcgtccgtgcttgtgagcgggaactggtttatctacatatgggcggtcaacaacgggcatgtcattgaaacaagtatgggatattacatcaacccacttgtcagcatcctgctcgggatggtctttttgaaagaaaaactgaaccgatggcaatgtcttgcttttctgctggcagcgtgcggcgtcgcgatccagacgttcagctacgggcatattccctggatcgccatcggccttgccctcacatttgggttttacggccttgtgaaaaagaaagtggacattgatgcttttatcggcctgacattcgaaacattctttgtgatgccggttgcgctcctctacttactggtgatccaggtaaaaggcacggcatcttttgcaacggtttcaccgggattaaccgtattgttaattggcacaggcgttgtgacggcaatcccgctcatttgctttgcacagggggcaagaagcatttccctgacaatgatcggctttttccaatacttgacgccgacgatgacgctgatcatgggcattgcctttttcaaggaaccttttacgcatgtgcagcttttgtcctttgcttttatctggctggcgcttatcgtgttttccgtttccggttttttgccgaagaagaaaatccatgtggaagaagttgcctgaggttgccatgccggaacgggtttactggaaaagtttttaaatgcatacaaaaaagcggcgggaacccacctggtttgtcccgccgcttttatatatgcggcaacttgtctgctaaaaaaggtattttaacaaatgatcttttcggccggcttttttttaacgggaaatttcaggtataatagggaagatcgaagtcacaagggagattggtttatgtccaggttccagttccgcccggcaacgtttaaaatggtttttttcatgtatttgctgggcacggttatttttgccattttgtatttgctgccggtttcacacaaacagccgttgctgccggtagatgcttttttcctgtccgcaagcgccattagtgcaacagggctgtccactgttaccgttgcgcaagaacttacaacggctggaaaaatcatcctgctcatccagatggaaatcggcgggatcggcgtcatggccttggtcggtgcgcttttaattgcattgcggacgaacgcgcctgttccgtctcaaacattgatgatttttgaccagaaccagaacagcagccgttcgatatccaaactgatggcctttattgtaaaatacacattaatcgtcgagacggcaggctttctgctgattctgccgtctgcactacagcacggcagccatgcttttgccgctttttttctttcggtgtcgacatttacaaacgccggctttgaaatttcgggaaacgggcttgataattttaaaggcgaaccgttcgtgcttgccgttttaagctgtatgatcattctgggcgtcctcgggtttgccgtcgtcatggagtttttgcagtcgcgccggaaaaagaaaagcctttatttcaaagtaaatgttttgatgcacggcattttgcttttggccggctttcttttcttcttttttgtcgattttatacatatgccggggctttcttttacagaaaaaattatccagtcccttttcttcagtgcggcgccgagaagcggggggctggcatcactcgatttgcacgttttttctttcccgtctctgctgtttatgatcatgctcatgtttatcggcgggtcgccaagcagctgcgccggcggaatccggacgaccacattcgccgtcattcttgccaaattgtggtctgtcatccgcggttcaaatgagacgcatatgttcagaaagacgctgtttgccgaagacgtaaacaaagcctttctcgtctttttcgcttttctttttttgttctttttctctttttttgtattgtcttttacggaaaaagcagcaccgtttccgcttgcatttgaaattatgtcggcgctgtcgacatgcggcttttcactcgggatcacggccggcctgacggtgttcggcaaaatttggctggctttccttatgctgattggccgtctcggggtgattattttgatctatacttttatgaatcaaaaaaaatccacaatcaaatatgcaaaagaatccattttaatcggttaggggtgggattgtgaaacatttaaaagaaagttttctagtgctcgggctcggccgcttcgggtcaagtgtgctgaaagaattggcgaggctcggatacgatgttgtcggcgccgataaaaatgaaaaggtacttcaggatgaggaactgcaggacgctgcatcgtaccttgcagaaggcgatgtgaccagcaccgcttttttggaagaactaaatgtgaccaatttcgatgcggtggtcgtcagcatgggagatgattttgagtccgccattttaacggtgcttgctttaaaagatcttggctgtgaaacggtttatgcgaaggcgaatgatcaaaagcgggggagaggcttgaaaggggccggtgcgacggacgtgttttttcccgaagaagatacggggcgccgggttgcctaccatattgcaaacccgggcattttgcagtatatccgcctgtcaccgtattgctccggccttgagatgacagtgccggaagattttatcggaaagtctctgacagaactcgatttccgcaacaggtataaagcccttgttgtcatggtcacttcccagactgaagaaacgccggttgtctcgccggcgccggattatatttttcagccaggggacaccattttcacagtcggtgcggaaaaagatttggaaagactgcgccggaaattttactagaaaggtgaggtattttccggctgcgttgaattgaactgcaggagctgccgtttttccggcctgggaattcccattcggggcgtcggcacgggagccggaaaaacttatccgccgggggataagtctcctggcccctactacatattttgcagaaaaatcgttgcggttaaataccgccttgcgagcatttgaaaataagccgtaaaaacggaaagggtcgcgatgacgatggtgttgcggatggcttcttttttcgggtcgtccggcgatatgtatttcgatatcatctcttccgctttttcagtaaccataccttccattgccgaaatcatatgttcatgtttttcggccgggaaccgcccgacttcccgcatggaattcagctcctcgaaaagctgggaataagtggcatacagctgtaccggattaatcaaatcatcatgctcatcttcggggtcattgacgatcaattgcaacagcttacggatggaatcgaaatcgagcgccgttttcaagtcttccaccagaaacagtagcgccatctggtcaatcgaatattttttccctttttccggcgccacgatcatttctttaatatcgcgcttgacccagttttgaatcgcggtcagtgtaaaatttgtattttcaatctggcttccgagcgccacgatttcatttaacgaaaatccgaagtcatccgtgttcttcttcagtatttttgtaaagatggggggcattacagcagctgcaaaggggtgatgcgggtctttgccaccgtttttctttgcccataagccttgtaaaaacgttgcaggcgtcatggggcctgctcccttcagcgcaagtagcagatctgccatttccctgcgtgtcatttggaatagttccattaacagcacctcccaaacattggcatgctactttttatcgtaagattgatggatggaaaagtcaatgatgatgataagactctttgtatcctttcatcatccagcaattcgtgatattatatctatgggaagacctctctatagatgtttattttacggtgtacatttagataatagagtgtcttcccattttttctcctcatctgccccttcgagaaaaatttttacacatacggcgtgacaagatttctccggtgtcccggaatgccaaggatgccttattctttcaggtgaaacaatccgcacttttaggaagaaaattacacctgtctcggtttgaaaacgtttaatgtcggcatttcagggaaaataaaaaccgggaatgcaatcttttgtcaaaaaagcttgcattttgattgataagttcatataataagttcataggaacctaatataaaaatagaaaaggggaaatgaagttgaagaaattttttgcgctgctcctggcatttacgtttgccttttcagttgtcgggattcacttttcaaacccggttgatgcaaggggataccgttctgtaaaacggtcttaccagacggtgccaaagacaacaacaccatcgtcaaaacaacagtcccattaccagtcgaaaacgaaccaaaatacaaattcggtttccggcaataaagccaatacagcgtcgtcttcatcgagaggcagctttgtaaaggggatgctgctcggcggtcttggcggcatgctgttcggatcgatgttcagccatctcggcggtttgggaacggctttgacggcaatggtcaatattttaatctttattgcgctgattctcatcgtcatcaaattgttccaatccgtattcggcaacaggaaaaaagatcgtgaggcttatgacagatggaagaattaaaactgtcagagcaagatttgattaacgcggtttgcacgtttgtggcagatcagcattatgcttatccggaaaatgtgatggcgatgctcacatacgatgatgataccggctacggcgcagatgtcgaactgaacggtaaagatctcgagccgctgactgagccgaaactgattcaggccatccgcaaatatttagaagaagaatacagcattgacccgtttgccgtcagtatccgactggaaattgaagatcaagatggcatggtggcatacgtagattaagaaacagcccggcaaatgccgggctgttttacactattttgatacatatttgtttcgtcctgcgccggctcctgcggcaagcatgagaatgccacagataatcatgaccacaaccggcatatgccagttatgcgcccggtcatacaaccagccgatcaaaaacgggccggctgccgccacgagataaccagcagactggctcatgccggacaaattggcagcttcagtggccgttttcgaacggaggccgataaacgcaagcgcgaggctgatgctggcaccctgggcgatgccgatcaaaatgatacaaatccacatccacaacatatgcccgccgtacaaaaggcctgtaagcccgcacaaataaaaaatcgtaatcccgaaaacaaggggaatctggtttttcatccgctccgcccaaatcggcgtcataaaagtggcgggcaggctgacgaactgcatgattgacaccatccagccggccgctacgaggcttgccccatggctgaccataatttccgcaagccaggcgatggtgctgtaaaatagaaacgactgcaggccgagaaaaagcgtcacctgccaggcgagcgaagacagccagaccgatcttccgggagtttcctgatgggtggaaaactttactttggcgtgctcacgcaattgggggagccacaccaaagcagccaggatagagaagatgccccagaaaagcagcccccatttccacccgagcccaaggccgttcacaatcgggacgctgacgccggaagcgagcgcggcaaatccgcccataacggttgtataaatactcgtcatcaacccgagttttgcaggcacccggtgtttaatgaggcttggcagcagcacattcccgatggcaatgcctgttccgataaaagccgtgccaatataaagcatggcggcattcccggccgtacgcgccaaaatgccgataaataatatgacgatcccaagaagcaatgtcaactcctggccaatccggcttgccagttttggcgcaagcggtgaaatcagtgcgaaggcaagaagcgggagcgtcgtaataaatcccgcttgtgcatttgacatatgaaggctgtggcggatcgtgccgattacgggcccgacggaagtgattgccggcctgagatttgctgcaatacagataacgcctgccacaagcagcccggataatactttttctttttctttctgatcacccatctttttctaaactcctttaaaactttcctgatttaaaaatggacagcaacagccataaaagcatcaatgttgcgacaccaaatccgatctcaatgatcgggtttttccagatcaccgtcgattggccgctgatggacgtgccgatcatcagcccgaccatcaggatactaaaggcgagcaggacgatcgcgaaggaaagccggttgctgatcctgtccagtttttccaaaaataaatacaaatccggtatgacgacttccatcctgaatttgcctttccgcatcgttttggaaatatcgcgcaaatttttcggaagctcgagcaaaatttccgcctggtccaaaaacgttttccatcctttccgtgcgaccctgcccggccgcaaacggtcccgaagcagcctttccccaaacgggcgcgcagcttcgatcaggctgaattccgggtcaagcgattccacgacaccctccaccgtaatcagcgatttgccgagtatcgtcagatcggcagggaagcggatatggtatttgaacgcgagatggtataaatcattgatggcttcccgcaagcttaactggctgagcggcagatcataatatttttcgcggagaacttcgacatcttcctttagcagatgaagatcggtttcttccggaatttccgcaagcgcatcgaccgacttcataatggcattcgtatccgcccgcatcagcgcaatgacaagtgaggcgcaatggtacttggtctcttccgtaagccggccgaccatgccgaaatccatataacaaatcacatcgccgggcaaaacgacaatgtttcccggatgcggatcgccgtgaaaaaatccctccacaaaaatctgctgcagcatcgaatggatcagccgttcagaaatggctttttttcggtatccggggactgtttcactgaaaaattcgctgattttcctgccctttatgtattccatggtcaggactctttttgtggaaaagtcccagtaaattttcggaatccggatgttttcatcgccttcaaattgtttggcgatccgttccgcattccggccttcatggtagtaatctagctcggacaacagcgcctgggaaaattcttcgacaatgtcccgcaattggtatgcccttgcccattcaaaacgggactctagggagagggacaggctttccaatatttcaagatcggtttcaatgactgggcggatattcgggcgctggattttgatcgcaaccggctcttccgtatgcaatttggctttatgcacttgtccgatcgatgcggttgcgagcggctccggatcgaattcggcaaaaagctcctcaacgcccgctccaaattcgtccctgataatcttttttacttcttcaaacggaaacggcgtggccttatcctgtaatttttccaggtcagcaataatcgattccggcaaaatatcacggcgggagctggcaagctgcccgagtttaataaaggtcgggcccaattcctctaaaaacagccggatcctttccccggtgctgcggtggggggtgcggggagccgcttttttcgagggaaaaggaagtaaatccgaaaggccccaatcgctgattaaataaccgaggccatttttaatcagggcgccggcaatttcctggtatctttttccgtgcttcatttttctggaaagcaagcaaccacccccggttttgttttatgcaaaaaaacagccggccccgggcaaaagggccaaccggtttacggattcaaccgttcttcaagctgctggatgcgaagttccagcgccttgatttcatcttttgtcgcaacattcatttcagaaaggatctcgttgacccggtctttcaaggcctgattcagttcttgtttggattgttcccctttttccagcagttcatcaatcaattgtgtcgattccgcttttgtcaggttgcctttttccacgaggcggttgactgctttttccacttgttctttgctgagcaccgccatgccaaggccgagtgataacaattggttcactttatcgcgcattccaattccttcctttctcctctatcttaatgtaatcatagcccaatccggccgggatcacaaacggaaaggtgtgaaaaatggccaatgaacggactactttccccagtgggaagcaataaacgtgtcgcggcccgatttcgcccggtcttcatgataggcattcgggtttttcttataaaaatcctggtggtaatcttcggcgggataaaaaggcttcgccggcaaaatttctgtcacaatcggctttttgaatttgccgctttctgcaagctgcttttttgaagcttctgccagccgcttttgctcttcattatggtaaaaaatagccgtccgatagttggagccgcgatcctggaactggccgccggcatcggtcggatcgatttgctgccaaaagatttcgagcagtttttcgtacggaaaaactgccggatcatatgtaatttggacggcttcgtaatggccggtcgttccggtttttacttgctcatacgaaggattttcaaccgttccccccgtgtacccggaaacgactttttcaatgccgtcccactggtcgaaaggtttgaccatgcaccaaaaacagccgccggcaaaagttgctttctgaaattgttccgccatttcttctcctccaaaggtgatactttttctaaatcgtaacatttcctgcgcatcacgacaagaaagaatgcccggtctgctgcggaaaaatcaaaaaattccggctgtatttgcccggttttggattttagaacatatcttttttgtgttgtccactaaagtgcaaaaaatttttaaaaaaatgtgtttaaaatttgaacattttgtgaacataaagtaatataatatacaaaagggaggggttgtgaaatgaaggaatttaaggggtactatctgcttgcaaccgctgagctgatcatgagtgtggtttttcttgccattcacttcattgtaagcgctcacacaacggactggtctttgattttgttttggggtttcctgctaggaggaatgattacctatgggctcggaatggcatacttgatgatgctttgcgcgtcagggaaagaattgccgcatgaatatccggaaggcgatccgtcatacagaaaagctggataatcgttcgcacagcatgaaccctgtatacacggggtttctttttttggtggggaagtgggcaccgatccaatcggatttacgatggctgaaaaaatttaagtggcgggaaatgcggcctttttcatgcaaaaaaaacgatgccgcaaagggcaccgttagtcttctttttgaacatttgccgcctgcgggccgcgtgatccttcttccacatcaaacgatactttctggccttcttcgagcgttttatagccttcaccctggatggctgagaaatggacaaacacgtcgtctccgccttcccgttcaataaaaccatagcctttttcactgttaaaccattttactgtaccatgttccacgtttaatgcctcctaatttttaacctttcttgcttttaatatatccagaatcccgggttttaaacgccatttctcatttgcaggtaaaatttgcggctttttttgctttatctttataaaaaaaacttcagtttttcgtgacaaaatcaattgtgatcgcgacagacatcgcttctggcaacacatacagaagtagtaatccaacttatatgtcctgaaaatatgcgccggccggtttttaccccccgttggtgcccgcattcatcccaggcgtggacttccatttggaaaaaagcttggtacactttgcggcatcaacattgatataatcgggcagccgttgtacacttttaaatagccggatagtgaaaacttcattgcaaaaggagctgtacccattcatgattgtttccggacaaaaggaacatcaactcatagaagaaacttttaaagatcaaatagatcatcacactgtgatcagcaaaaaactcgaacagtcaggccaatttatggaagccgtccgcagtctgattgacttatgcggtgatgatccggaccgcgacggattgcaggaaacgccttaccgggtgctgaaggcatttttggaatatacagaagggtaccgggaagacccgaaattgcatttggcaaaaacatttgatgtcgatcacgatcacaaggagcttgtactcgtaaaagatattgaattttattccatatgcgagcaccacttcgcgccatttttcggcgtcgctcatgtcgcctattttccaaatgaaaaaatcaccggcctgtcgaaaattgcgcgcatggtcgacggctacgccaggcgttttcaagttcaggaacggctgacaaaacaaattgcggatgcggtggaagaagtgcttgaaccgcagggcacgatggtggttttagaggccaagcatatgtgcatgtgcgggcggggcgtgaaaaagtcggatgcgtccacgacaacgatgtcttaccgcggtatttttgaagggcgggcggatttgcgcgccgaatttttgtccttactcaaatagaaaaaaggatggtgcttatgctggatgcggacatattgatcatcgggggcggccctgccggcatttcagcagcgatctggtgcagccggcttggcatggaccatctgctcgttgaggaacagcagatgcttggcgggcagctcgggctgatccataatcgcattattgattatcccggcctgcaagcggaaaacggggaggaaatgcgccgctattttgttcggcatgccgagtcgttgcaatgccggtaccgggtgaatacgcgtgccgtaaagatagatgccaaaagaaaagttgcggtggcggaaacaggcgggcttaagacccaaatcggttttcgctacttgatttatgctgccggtgccgtccggagaaagctcggcgtgccgggggaaaaagagatgttctcccgcggggaaacttattcggctacgaaggacagtcatttgtttaaagggaaatctgttgcagttgtcggcggcggcgaccgtgcttttgagggggcttgtttgcttgccgaagcaggggcgcacgtctatcttattcaccgctcggaacgtttcagggccaggcaggcatatctcagtcgggcccaatcatataggaacattcggattttgccgaatatgcgtgtgaaaaccattatcggggaaaaccaaaccgaagcggtggaactcatccattcaagcggtgaatcctgttttttgccggtatccgcagttttcgtccggattgggatggaaccgaacagcggtctcgttcaggatgttgccgggacggatgcggacgggtacattgtttcggacggttacgggaaaaccgaatgtgaatggctgtatgcaatcggagacaactgccttggcccgctttattccagtattgcaggggcggccgggcagggggctgctgcagcaaagcatattgcctcccgtttggcgggagtacccgcccggtaaaataaacgatctaccggcttcacggccctgcgcacgccggcataaggccgggcaatgcgttccggcgagaagatggggcgtttttcggaaaaagcaacgaaagtgtacagaggcgatggtctgtaaaacattttgccccgtgcctttctgttttaatcccggccgccagtttgtggggcatcttccccgcccagcacccggctgaatgcggcagaaactttttcatattcttcgtccgaatggagggcgtccaggtcgccttcttcgtctgttttcaagaaaaacacatctaagtcccggcctgtctgttcctctaaatcttcaacaaaagaaacggcggcatattctgttccttccagcgacaatacgccgatgatttccacttcctgctcatgcccgttttccgtaattgtaaacacttcaccctgttcaatatttgccatcgggtctcctccttcgcttcttgttcggtattgtatacaaaaacggaaaaaacatgccgaaaaaatacgcttatgatcgcagccgactatcggaaaggagtgtttatatatggataaaaaagacatggaagaaaaaatcattcagcaatacaaaatggatgagaaaatgatggcactcatttttgcccagtggtgcgtgaacaatgggcttgatccggaagaactttacagcagggcatatccgcaacaagaaaaaaatggcttgctggaagaagcgcttgccctaacggtaccgaaagaagaagcgggagaaatcagcaccgggactgtattgaatgtattatccttatttggcaatgacgatttggctttcgttgtgtcggaagaaaacgccaagttaaaacggtgagtccagaaacaaacctgcgtggagacgacccataatggtgttttttcaattccggaaatgacaaaatcaccccttggatgcccaaggggtgatcattataaggaatcgcgtatcgcctttttaaatccttcgacagagagcagggcaaaaaccgaataaagcaacgtatataggcccatcacgatcagcatcggtgtccacagttcggacccgaaaaagaaccagccggattttactgcaaagtagctgtgcgcaagaccgagcaaaagtggaatgccgaaattgtaaagctgcttgatccggatccctgttgttaaatcctgcatggtaaagccaagcttgcgcaaaatggtgtaggccggtttttcttcttcgctttcttccatttgtttgaaatacaaaatgcagccggatgtgaccaggaaagtgagtccaagaaatccgacaataaacatcataacccccatgttttctttttgcattttgatgatttcaggactggagtaggcaaaggaatccgaagggaaatgcagactttggaacaaccggtttgctttgccaagatcttcatcctttttcagattgatgccggtaaaaagattcgagtccaattgaatttttgggtccgtatccttttttaacgcctggaataatgcatcatccgttaccagaacgggcatgctgcctgaaaaataattggaaagaacctggtcttttcgaagggcaacggtgcgcagtctggctgttttccgcttgcccgttaagtcaatcatcccttccgatttcatcggcataaatctggctaaagcatcggaatagccggaaaaaaccgcctgcccgggttttacatccattccttttactgccgcatcgcttacgaccgctatcggtacagctttggagtcgaacttcagatcttttgactttttatcgaacaggctgcttaaatcggctgtaacccttacgacttcaatttcttctttttcataggcgatgttgttttcatttaaacgttctgtaaattgttttgcctcattcgtcttgataaatgaaaagtccgcagctgtcatattatgggctgtttcttcagcagaataaaaggtaatgtagcttaatgacaataagccgatcgcaagcgccgacacggttgtgataatggtcagcagcactgcgttcgaacggatccggaacatgatggcggatagtgacatgacatcccggatattcagatacccgcctttctttttccggataaggtaaaagacaaaccggacagaagtcttataaaatagataggtcccgaaaataacaagggctaaaatgctaatcattgccgtatacagagcacgcactgttacaaagtctccattgaacaattctgatgaaatatagtatcctgccccgatgcatacaaatccgatgaccccgagcagcaatcccgctttggagattcgtccggcccggtcttccgtggaggaaacggtacggaaaagggaaaggatcgtctgccgtttgataaagatgctgttgatcagcaggaccaggatgaaaataatggtaaagacaaggagcgtctgcccgaaagccttcatcgaaaaataaagggaaacctttgtttccacttgaatgatccggagcagcagcatcatcagcagcttggatgccgcaaacccgaaaaagatgccggcaaagagtgagccgtagtagagcaaaaaattctccgtccctaaaatccggaacacttcttttttcgtcatgccgacaagctggaaaagcccgatttccttgctccgccttttcataaacaaatggttggcataaaagagaaacaccgccacaatgacgatcagcaaaaccgacgccaccttcagcgcggccagcccttttacggaagattttacttcgacgagagaaggggcgtattgcagtgtcacaaacgcaaagtataatgcagcactgaaggcgagtgcgaaaatatacagcgcataatgcggaaggttctttttaaaattgcggtaaatcaaaccgttaatcgtcatgctgcacacctcccagcacggcctgtgttttcaggatggcctgatagaaatcctgtcttgattcggtgcctttatgcagttgggaataaatctgcccgtctttaatgaaaatgaccctgcccgaatagctggctgcggccgcatcatgggtgaccattaagatggttgcttttcttttttcgttcaggcggcttaatttattcaaaaggtcggatgccgactttgaatcgagcgcacctgttggttcgtcggcaaaaataagacccggttcatggacaaacgcccgcgctgccgatgtccgctgcttctgcccgccggatatttcattcggatacttgtcctgaatatccataatgccaagttcttccgcaaccgcatggaatttttcgtccgcctcgcgttttgaaacttttttcacagacagcggcagcaatatattttccttcaccgttaacgtatcaagcaaatggtattcctggaaaataaagcctaaatgccttttccggaactccgccagctgcttgtctttcattttcgtcaacgccttgccttcgatttcaatggaaccgcggctgggccggtcaatagaggataaaacatttaacaatgtcgtttttccggaaccggacggccccataatgctcgtgaattctcctttttcaacatttaaatcaatcccttttaaaacttcttgtttgttccacttgttgccgtacgttttataaacattttttgcttcaaggatcatgattggctccccctttctgatatgatttcattatagaaaagccggcatgcttcttccttcgtttcagctaacaatacagaaaagcatatgacagttttgtcacatgcctgtaatttgctgcaagctatttctttccgggaagatgagcgtaaaggtcgaaccggcgccgggaaccgactggacagtaagcaggatatttaatttttccgccgcccttttggcaagatacaggccgaggccggttgcccccctgttttggctgcggtcagaagaggtaaatcccttttcaaaaatgcgcggcaaatctttcgggtcaatgccgcgccccttgtctgccaccgataattggaagcggccgtctgctatttttccggaaatggagatgtctgtcccgcaactgtactggaccgcatttaccagcaattgccggaggataaacgacagccattttgcatctgtaaccattgccggaacccccggtgagacgtcaaaaccgatgcctttttgaatgcaccatggctgaatcgctttgatttcctggaagatcaggcgtttcaggtcaacattttccatataaacgtcattttccatattgccgatccgtttttcatgaagctgtttgtcaagcaggtggtggatgcgcagccattcataattgagcgacacttttgcttcttcatcttgaagccggtcaatgatgagctgcatggcggtcatcggcgttttgacctcatgtacccatgctgttaattcatcttgttcttcttgcaccgtggatgcgttccggtcggtttccgcccgtagatgttccgcctgcgcttgtacggcctgatgcacgatctgttcaaaaggggttctggggcgggtgatctcgctcgtatcaagatccccatcccattctgaaaggctttgataaaatttcacttctttccgggcgcggaagaaaaggaaaagaagaaaagcaatcgtttctaaaaaaacgatataaagaacggatgaaagcgcgatttgcggatcaagccaggcaatgaaaagcagcatcagctggcaggcggcaaaaaatattacccagctttttcgttcaacaagaaacatccggatcataggccggcatccttttcaagcgccatatagccctggcccacttttgtttcgatacagtcaccgagcccgatcgtggaaagttttttccgcaggcggttgacgttcacggtcaatgtattatcgctcacaaacctttcatcgtcccataaacattcgatcagatgcgtgcggctcacaatccggtttttcatgtccaccaatatttttaaaataaacatttcgttttttgacagttcaatgcatccatgttcattttcgaccgtgtttttctgcaaatcgattgtggccccgcaccatgtttttaaaaccgtctgctcgctcgtgtaggcatatacccggcgcaaaatggcctggattttggcgattaacacgtcgatatgaaaaggcttttgcacataatcgtccgcgccgagctgcatcgccatcaccatatctgtcggatggtcgcgggaagaaagaaaaaggatcgggacatgggagtgcgcgcgaatttgtcggcaccagtggaacccgtcaaatttcggtagctggatgtcaatgactaccagatcaggccggaattccgtaaattcctccatcacctgtccaaaatcgcggatccccgcaacttcaaatgaccactgcgaaagtctttctttcacttcacgaaacagcgtcacatcgtcttcaatgattagaatttttatcaaccggaccactctttctatttttgctaccctccattttacaagaaaaggcgaaagcaggctacaggtgcagattttcttttatttaaggttgctgtaaggttttctttagattggggaaaggtagcatccttatcgttaaaattggaaagaaaaactctaatcataatggaaatgggcttattatctagtggctgcttctgctattgtacaaacacacaatctgaccaaaacgtatgagggcattcatcgtgtagaccaagttcatcttcaagtagaggaaggggaaatctatggatttctcggaccaaacggggctggaaaaacaactacgttaaaaatgttgcttggacttgtgaaaccttctaaaggggacatcgaaatttttggtaaaagtttgaaaaggcatcgatcaaccattctgcaacgcacagggtcactcattgaatctccttcttactatggacatttgaccggtctcgaaaacatgaaggtcatgcagcggctgcgaaatgttccggatcagaatgtggaggaggcgcttcgaatcgtacggcttgagaatcagaaaaataaaaaagctgaacaatattcactcggaatgaagcaacggttggggattgcgatgtcgcttcttgcttttcccaagctgctgatccttgatgagcctacgaacggtcttgatcccgcgggaataggtggaatccgggaacttattaaatcgctgcctaagcgttatggcatgaccgttttgatctcaagccatcttttatcagagatagatcagatcgctacgtcagtaggtatcatcagtgaaggaaaattattgttttaaggcagtatggcaagtcttcggaaaaaaggcaatacctcgatctatataaaaaccggagacaatgcaaaagccgaacaattatttctttccaaaggatatcgttctgttcaagacggaagcaggctgaaggtaggatatcttgatgatacagaaattgcagaaatgaaccggttacttgtcgaacatcatattcctgttacccggattgaggagcataagaaaagtgttgaggatatttttctggagttaacgggaagggagcgaagtttgtaatgatattactcagtttggaatttttcaaaatacggcgcaaaaaaattggggtgatgattgtatttttccttttagttgagatgatgttggcgtttatcactacaagtatttcgatcgcgaatcaccctgaccaagccgtctgggaatccatcattttcaatatagttactatgaatggcctttttatgccgatcctttctgctgtggtcgtttccaggatttgtgatatggagcataaaggggggacctggaaaatgcttgttgctaccaatgtgagccgtgcacgtctttatgcagcgaaatatatatgcgccaatagtttgcttttgttttgtatttttgtacaaacggtcatcaggttgtgattggactggtcaagcactttactggtgaacctccaatcgcttattttatttggtttatcgggggtgccttgttgacaacgcttgctgtaacagcgcttcaacaatgggtttctctagccattaaaaaccaagcctttgcattggtgttgggcatgcttggtgctttcatcggaatgactgcaggtttgttcccagctgctgcccggcatatttttatctggtcttattatttggatcttagccccgttacctttaaatacaccgggtcttcaggcgcctatacagctcaacctgttgatatcgggctggtaatcgctgcgttcgttatgactgttgtattctatattgccggaaatatcaatgttaaccagcaagaaatttaggagggatgttgatgctacgaagtatttctgccgagtttttaaaattacggtattcccggattggacttgtattgattgtccttccaatcataagcctgttgatcggatgtgcgaatttttatttgaatcaaggtgtcctgcataatggctggtacagcttgtggacgcaggttagcctattttacggtgagtttttccttccaatcttaatcgccatttgctgtgcttatgtatgcaggttggagcatcagaaccggaattggaatacgatcatggcctctcctgttcccgttgcaagtctcttttttgccaaaatgattgtcgttagtatgctaattttaatcgtgcaggcgctgtttctctgcctttactggtttgcaggcactcttttttctttacctagatctcttgcctatggagactttaagttggaccttacgcggctggtacgcgtctttatccatatgtgcgtttcagttatgtctgtcgctatggattcttagctttgctacgccgattggtatgagtctgtgtgccgtttttatcgttttaggtatatatgttatgaaactgggtatcttttttcccattttcgcttctgaccattggaatgagggcgttgagtcaggaaaggcttaacgggatccagaacattctattttggattatgaatatgcttatatgatcatttttgtgatgatctctattcgtcggttgaaaaataaggatgttgtatcatcctgaatggttgaggtgggatgtttaatgaaaaaaatagtattagtttaacgctcatactggggaacagcctctttctaggcgcatgcagttcactggaacccgataatccaaagggaaaaacgatgtattatacagagataaagttaagtccatataattgtgtaaaaagggttatctgaatatgagggaatatggagtataggggctgtttttctggagggggctggccagccccctccagaaaaacagcgggatttcatttctcttgccgtctctatcatttttttatagaaaatgagccagagcccatcatctcagttagaatagagttaaccaaaaaactaaatttctaaaggagagattcagggatggctcaattacagattactctagatgaacaacttttgcatcaattatttcttggcgattcaaaagaatcgggtataaatgcccttttggaggcgattttgaatcaagttctggaggcacaggccagcgaacagctgaaagccgaaaaatatgaacgtaatgaagctagaattgattaccgaaacggctcctacccccgccaactaaaaacccgcgtgggaaagctctctttgtacgttcccaggctgcgcaacggtcatttttcaactgatctctttcagcgttatcagcgtagtgaacaagcactggtcctgtctttgatggaaatggtgattaatggtgtttctacgcgccgtgtcagtcaaatcaccgaagagctctgtggttcagacttctcgaagtcgaccgtgtcgaatctttgtgggcagctggatcccgtggttacgggctggaataaccgtcccctagagggcagctatccgtttctgtttgtggatgcaatttatacaaaggtgcgtgaaaatggccgtgtccgttcccggggtgtattgattagctatggtgtcaacgagaaaggctatcgatcgattcttggcctaaaagtcgatgacagtgaaagcacagaggcttggaagaattattttgattggctaaaatctcgtggactaaagggcgtagatgtaatcgttagcgatgatcatggcggtttagtcagcgctgttcaaaaagcgtttcagggagcaacgtggcaaagatgtcaagctcattttctgcgtaacgtacacgatcggcttccaaaacatttagagagcgaaggaactgaacaagtgaaagccattctccacgctccagacattgaaacagcacacacactacttcagtcctttctgaatacttatcaggataaagcgcctaaagtgactgaaatggtagaggaagcctttgacgatgtcactgcagcactctcacttccggagccgtatcatcgtcgcctgaggacgacaaacggcatggaacgactcaatgaagaatttcgccgtcgggaacaggttatccgtatttttcctaactgggattccgtaatccggctaatgggttctgttctcatggaaaaggatgaaaaatggacagaaggacgccgctatttgaagatggaagactattttgaatggaaagccaaacaaccgaaatcgtctgaccaatccaacaaagcgacagacatttattcgggttaattactctaccccgactgagaggaatttacacacaaaaaaaagacttgacccttagtaagagctagacaacaggatgacacggagaagctggcactattttttccattcgacctcgagtccctataggagcttcgctagcctctgccttatgactagaccgaacgaaggaatgtaggcacacagatgcccagggacatgggagggtacgtcatcataagttacgcagagaaccattgtgcatcgtataatttcctatcactacttcccattattatccaatagtgaccgcgtagcgtacccgtatgttggaatagtttcacataatataaaaattttgttaggaagcgtgccaaaaaatattttttgacatcccactaacggcttaaaccgttgatacatcaacatctatagagggagggaatgatgactacgctcacattttttatggagaaaaaacatagtctcccagataaatcgatagccaaaggagtgattgataaattaaagaaatcaaacggcttaccaccggggaattatgctgtttatatcaaaagcaacgaaatattaaaaagaacaggaacggcgaaaaagcaggaaggtacaacatcagggatagatgatatcatcttggaacctagtaaatgaggtgtggttaatgagcattttaaaacaaaatgataatacttctgatcgagatcttattaagttgtgtggttttaatatttatcaacagtctaaaaataagggaacacgctgccaatgtcaaacgatcctttcctcacgtcctttatagacggaacctgtccgcgcgatacgcttttaaatagggcttgctgaacgaatccggttctgaatttgtgcccaatttgtctgcaaactccatcgcaaaatatatgcgaaaatgcgtgagtttgtcttctccatacgttgaatcggctttcgcgtgcaggcatttccctggatttgttgtaaaacctttgcatttaaatggttgccaaagctgtcagcatctttgccaaatctaggaataaggatctgttatggctgaaaaagatggagggtgcagatcttgaatttaaagcacgcacgatggacctgatggaaccctttttggattttgatttaaaatcatgtgttgacatatcgttatttttcgatataatgatttgtatggaactcattgaagtctttaaagccttatccaatgaatcaagattgcaaattttaaaatggctgaaagaaccggatcgtcattttacgccccacgaagggattgatatgaatactacaggggtatgtgttagtcaaataacagataaattgaaaatgacgcaatccacagtatctcaatacctttccatactgcaacgagctgggttaattacggcagaacgtattggtaaatatacttactacaaaagagatgaagaagccataaaaaaaattgccactctctttgaaaagaatatttaaaaaatgaaactgaatcctgattatgaatacagtttcatttccttaaacatatcgacatatcacgatatgtgtttttgtcgatacaaaacgttcaaccctgatatattttgatgatgaaggagtgatttattttgtcaaacactggtaagatctatatcttagcgatcgtaagttttttagttggaacttcacagtatatcatttccggaattttggataatatttcggaatcattaggcattactctcgcagcagctggtcagttaataaccattttttcgcttgtatatgctattttcacacctgtattaatggctatcacctccagaatggataaacgtaagttaatgatatattcacttggtctatttgttattggaaatattcttgcattcatccttcctggttatggattctttattgtctcaaggattattatggcctttggtgcaggaatggttgtagtgacagccttaacgattgcggagaaaattgctccaaaagggaagaaagctagcgccattgccactgtcattatgggattgacagcatcattaatcattggcgttccacttggaagaatgacgagtgaggtactgggttggaaggctgtttttggagggattgccttacttggattagttgcgatggttattatttcgcttaccattccaaaaattcaggtggaaaaattgacacctttaaatcagcaactcgctttattaaaaaaaccaaaagtggtactcggattagccatcacttttttctggcttggcggatattccattgtttatacctacttatccccttacctgctaaatatttcaggtgtaagtgacaaattgcttagcggcgttctccttatatttggtattgccagtctagttggatcaaagtttggcggatttagtaccgatcggtggggtgtgcggttcacactcattggtggcatgatcttacatatcaccatgctcgttctgttatcaatcgttacccactcttacgtgggcgtgttggtcatattaatattatggtcctttgcagcatggtctactggcccgactcaacaatatcacctagctacaatagagccggaatcatctagtgtattgctcggtctcaatcaatcaatgatgcagttggccatggcggcaggggcaggcattgggggtatctttgtagagagaatttccctcacttccattacctggttagccgctttaggcgttacaattgcaattggattaacaatattgacttcacgttctccttctaaaaagacctcagtcgactgcaacgtcgtgaagtcgcaataaattgttagaatcgtaccttgttgtcaaattagtgaattgaaagttcaaagcaaggaacgaataccaagtaagaattcctgcacatgctcagattgtagacaaataggggttcagaacttgtccctaagttctgaaccccattatgatgctcatcttcaaactcgtaaatagaatataaaaaatatactaaaataacaaattttaggttttgttcgctcatccaagtgtattgccccttataaatgggtacaagaaattatccggcaagcataatcacgtaacgatgacggagggataatgtatgagtgaacaaatccgaaatggtcaaaaaccggcaaaggggattgccccaaatgtggaacccgatgccttatacaatgataaaagaaaagttttcctctttggttccccaagctacacaaatatcggggaccaggccattgcctatgcagaggaaaaatttatccgtaaccattttccttattacgaatacatcgaaataatggattatgcgacggatgagggaattgattttgtgaaaaagatcattgggaaagaggacatcgtctgctttacgggcggcggtaatctcggcagtctctacctggacattgaagaagaccgtcgaaaagtaatctcggcttttaaagattataaaaccatctctatgccgcaatccgtttattttgaacctaccgaaaaaggacagcgggagaaaaggaaatcgcaggaagcctatggcagtaatccaaatctcaccatatgtgtccgcgaatcacaaagcctggaattcgtcaaggagaccttcaacgcaaatgtattgtacaccccggatatggttctgtcgttaaaaattgaaccgcaggatctaaaaagggatggcgtgctttttgtattaagggcggataaagaaaaagtgacagatgaaaattttgtctccgaactcatggaaagagctgcgaacatcgggcctgttgaccgcacggataccgttttatcggaagtggacacgatcgattatgcggacagggaaacctattttatgaaaatgctgcaccggatcggctcgcgcaaacttgtcattaccgaccggttgcacgcgatgattttttcaattatcaccagaacgccgtgcctcgtattcggcaatagctacgggaaagctaaacattcctataccgactggctttccggattgaattttatccagtatacggacaagcaggatccggatgaactggaaccgttgattgcccgcttgctccagacggaaccgaatgaaatagatttgtcggaagatttccaggtactgcgggattattttaaatcttaaaatggtgcacgtctatccgatgtcggccgtattaaacccacttttatgttcagcttgtatccgccgggcttttttaacaaggcgtgcatgtttaccacttgcctgcaaatagtaaaacaagggcgcaaaattaggcggggcagcctgacgcgcggtcccggctgaacgtgaatcaacaacaaaggagaatgcacatgaagaaaaaagatcgatttttggaaggcgcgaaagtcacgaaagacaatcaaatattcgggacaccgaacagcaaagcaaaagatggaactggaaactcaccgaacgatgatgtaagagaaagaaacaaccggtagcgggcccgatgcactgtttaaaaagactgctcctctttggggacagtcttttttaaaaacaaataaaaaaaggaatgtttaaattattctatgataataaaatacttgttccttgtatataaacaattgtatttcgggtaaaaacatattacaatgaaaaagtaatttgttataaagactgacaatgctatttttctattttttaagcatgtttgaaaaaaacagcgggagtgaatggcgtggaagaaagagagttaaacagaggcttgcatgcgcggcatattcaaatgattgcgattggcggtacaatcggtgtcgggttgtttatggggtctgccagcaccattaagtggacagggccgtccgtgttgctggcgtatgcgattgccgggatttttatcttttttattatgcgtgcaatgggagaaatgctctacgttgagccaagcacgggctcctttgccacattcggccatcagtacattcatccgctcgcaggttttctcacagcctggagcaactggttccagtgggtgattgtcggtatgtcggaaatcattgccgttggatcttacatgcaattttggtttccgcacttgccggcatggattccggggcttgtagccatggtgatcctcggaacggccaacctcgtatctgtaaaatcgtttggcgagtttgagttctggtttgcgatgattaaagtggtaacgattatttttatgattatagccgggcttgccatcattttattcgggatcggcaacggggggcatgccgtcgggttttccaatctgtgggagcatggcggtttctttaccggcgggctgaaaggtttcttctttgccttatctttggtcgtagcagcctaccagggtgttgaactgatcggcattacggcaggcgaagcaaaaaaccccagccatacattgaaaaatgcgatccaaaatatcatttggcgcatattgatcttctatattggcgccattttcgtcattgttacgctttatccgtggaatgaacttgattccatcggcagcccgtttgtggcgacttttgcaaaaatcggcattacggccgcagccggcatcattaattttgttgtcgttaccgccgcattatccggttgcaacagcggtatctacagtgccggccggatgctgtatacgctcggcgtgaacggccaggcaccgaaaattttcacgaaagtatcaagcaatggcgttccacttttaggtacaatcggtgttcttgtcggccttgtgattggtgtagtgttaagctatatcgcaccgaaaaatctgttcgtatatgtatacagtgcaagcgtcctgccggggatggtgccatggtttgtcattttaatcagtcagatccggtttagaaagatgaaaaaggctgaaatgaaaaaccatccgtttaaaatgccgtttgcaccggtttccaactatgtaaccattgcatttttaatcgctgtcctgatcggcatgtggtttaatgatgaaacaaggatgtcacttgttgcgggcattgtctttcttggccttgtcacggtctgttactttgttttcggcattggccgtgcaagttcaaaaaatgcgaaagtgcaagcatccaaagggaaaaagatactggatcacccccaatcatgaacaaaaatagcgtgcgaatggagcacgctatttttgttcatttacgatggccccggctttcttcttcaaccgttcaagcacatgatccagttcgtccggctgcagaaattcaacgggggaaaaccctttttcaaagaggatggattcagactcgacgatcgtgacataccggtctccgattttggcgagatggaccgtttcgccaaaatcggaaaggagggcattcaccgaaatatggtccagtttcattcgcaaatcggcctccggggcagtttcgacaatctgggccgcggcttcgataacctgttccgccggcaatcgttcctgtaacgtccgcttggggcttgcttcccaaatctcaagttctttttcgaattgctcgtattcgatgctgtcttcatgcagcacttcctgaaaatgttcttccaccatcgtcttcacttgcgctttcatgatttccggcatcgattcgccgtattccacatactttaaaaattcttcgaaataacgggcgtgagatgcctggtgaattttcagctctgattcttcaatcatgccttcttccggcatatgcggatactggatggatttcatgccttttgtggtaatcgccatttccacttttttcaacaatgtggattcatcggcaatcgtggcgactttcggttcgaaatcgcatttcaacaaaaaaacaaacggttcatcgaagtatttccgcatcgttgcatttgcgatcagaaacgcgccgtccctgacagcattggtgtccagataggcggcgagaaaggcttcgcttgctttttgaaactcaccaatcgtgccggccatacgcgcacggttaaacaaattgaagttcgggttggagtcaaggccgtagcccggttccacaataaagcggccgattttcgtcggtacttgttcggacttcggatgcttatccactttcctttttacgattttttcaagttcgccatcgagaaagtcttttacgttacttatctcataattttcgcgatctaaagtttgaaagtgcctgaactgttttctcgtttgttcgccttccccgtctgtctggatgacatagaaggaaaggaaattgatgttaaaatccaatcgtttcacccggtttctcttttttcactgagcactattttacttgaaaaaacgggtttccacaatgtgcttgctggacgcggatgatttgcgggattaaaatggataggaaaacggatttttgaaaaaagaggtggagatttgcaaacctttttacatattctgcttttaagtacggttgaacttttcaacctgcttggaacgatcattgtggtcgggtttgtgctcggttttttggaaaagcgggcaacggccttcatttaccacgttttcgggtggaaggggattgcggtgacggcatggctcggtacgccggtccatgaatttagccatgccttgatgtgcggcatttttaggcatgaaattgtcgagatcaaatggctccagctgaaaagcggtgatggcacgcttgggtatgtaagccaccaatacaacccggacagcgtttaccaaaaaatcggaaattttttcattggaactgccccggtgtatatcggcattttgattttgtcgctaggcatgtatgtgctattgccggatacataccggccgttcatgcaggcaatcagggcaggtcttcatccgtattccggcctcgaaagtttctttgcattttttggccattccatcggcgcactcgctagtcatcttttttcaatcgaaaacttaatgaacccccgtttttggatttttgctattgccggcatttgcatttccgcgcatatttcgttgagcaccgcggatttaaaaggggcatggaacggctgcctgtcaatttttggttttcttgttttcctgaatgtggccggttttctcttcggattccggacaaacggcctgattgcgcgcatctcggcttataatttatatattttagcgttttcgggcattgcgttcctgttttctcttgtttggatgagcattgggttgctttctgtatgggcaaaaaagatccgataacgaaaaagcgtggcatgcttccttttgccgcgctttttccgttacccctcgtgcacacgcagttttcttcttgaaggttgtaaaaggaacatcgatgcctcgaatcatctcttttttgataggcttcattttcgtagttgaatgacgcttaaatgcccgaagtaattgcaaccaaaagaaagctgttaatcaaaatactcaacacaatgaggatgatggttagaatcggaacaaatttcaagtgtttcgatgatttggatttagccagttttatatatccaatgaacagatagataatactcacgattgccaatatataaggtatcgaaaaggaaataatcggattgtgtatgatcgtaagtaggtcttgtacacctgctgataaaaaaaacgaaaacaaggaaaaaatcaatgaaaccacaaagaaattcgtcttttttgatgacaaaatgatcacctctattcgactctacagttatactccattatataccattacaataaataagggcttgctgaacgaatccaattttgactttgtctcaatatatagaagaatggtgtatctgtgaaaatgcgtcaagctgccttctctatacattgaatcagctttcgagtgcaagctttttctggattccattgaaaacgatatccagtgggtgaaagaaaaagctggaaaggcggaatcagatgcttagagaaaaaggccaggcgtatgacacccctgacctcatccgtaaaataaaatttgacaaagaaaagcagcatttggatgcataatacattagtaagttgtatgctttgatgacggggtctcaaaagccgttaccttcctctattttataccgcccgggcacgcgcagtttttaagctgaggagaaagaaaaatgcgctcactgcaactaaaacagctgacaggataagaaaacgggctgttgacatgccgcttgcgaacacaacgccgagcacgaccgatgacaggatcgagcctaaataccggcatgtttggaaaaggccggagcttgtgccaaccatggcttcaggcgattcgttcagcattgccgcctgcagcgcaacattgccgatcccgtaaccgataccgaggataaacaggatcacacccatcagccagaccgaggcatggataaagaaaacggccatgaaaacggcgccggcaatcatagtcaaagcactgatccggatcggtccggcggttccggcacggtcaatccatttacccgaaacgagggaaatgaggatgcttgcgccggacataaagagcatcatgaacccgcttgtgtgcacgctgaaatgaagcccgtcctggtagaagctcggcagtccgaagaataagcagtaattaaataaattcagcacgatgaattgcaaatacacaacagaaagggaacggtgcttggataaaaagcggacatcaataaacgggcggcctgttctggcttcatagatcacaaataggacaagcagcacaatgcctgccacacccgtccaaatatggacagccgactccagttccaacagaaaatacagaagcagtacaagcccggccgcaaataagaaaatgccggtccagtcgagctcgtgcacaacatctttgaaagaagcatgtctgttctccggatctttcgggaagataaaccagccaagtagaaaactaatcacgataaaagggaagttcacgagaaaaatcgacggccagccgccaatcccgattaaaattccgccggcagtcggtccgagcgccgtcatggcagacgcaaaaatggacaaaacagcaagcgcagaggcttggttttcatgaatatgggtacgaatcagtgcgacaccggacggataaatagcactggaaccgatcgattggaaaagccgcatgagcagcagcacgaaaaaggccggggcaagcggcgcaccgattgccgaaacggcaacaagcaaaagccctgcaagaaacatttttttgcgcccgatcatatcgccgatttttccggtcacaggctgggcgaccgcgcttgccaaataaaaggatgaaatgagccacgacacagttgaaaaactcaaatggaaatctttttgaatgctgtgaagggcgagcgagatcatcgatgaattcagcgggttcagcatcgtaccagatgcaatggctgttaaaaaaaccgttcttttcgataaaggcatcacaatcctcctcgcttcagatgaaagccttctttctagagcatatcttttaccttgtcttccacgtccattcaaaacagaagtatcatacaacaaatatttcgggggtgcaaatattatgtcagtgaaggtccgcttttctaagcccgcctttttcgtgcagctgaaacaagccatcctgagtgctctcccaagccgcaaaaccagccaaaactgccggaaagcacctgcttagtaaacttgaaccccagcaatgaaacaaaagcggtttgtcctgtaagaatgcttcaaccctttacgtgaagcattccagtttgcgatttccgttttttctgtcataataaagaaacaaaaacaagaagaattgaggtaggaacatgaacgttaaaatcaatcggaatgccgcaaaaatgtttaaaaaaatattggaggaggaagatgcggaaggaaaaatgatccgcgtctttgtgaccgagatgcacggcgaccatgcccattacgacatcacgctggatacaccgggagaacatgatgaaattgtcaaaacggataagggcattgatattttacttgattcacgcgagccgtatttggacggcatctggatccagtatttttacgtgccgcaggaagaattcgtcattacaaacccgaggattgaacgcgaacacggtcatcaccatcatcattgattttttttatgttgaaaggcagtgctttttaaattggccagccatcaggcgatgcacattttgaaaaaggggatgaacaagatgaagcatcatccggttttactgttgtcttacggagagaaagaaggcggatagagacagaaatgacgggaggaggacgacggtttgtttagtgtattggggaaattagggtggttttttaaagcctattggaaaagatatgcgattgcagtgcttgcgctttcaattgttaacttgttggaagtgctcccgccgatgattctcggcgattccattgataaaatattcaccggggaaatgacagcacacattttttccctctacatcggcgtcatgctggcgattgcagctgccctttacggcctgacctatatatggcagtataacttgtttggcggggcgtttatcgtggaaaaaatgctgcggtcccggttaatgaatcattttttaaaaatggcgcctcctttttttgagcggaatcgtacgggcgacttaatggcgcgggcgacgaatgacttgcgggcggtgtcccagacagcgggtttcgggattctgacgcttgttgattcaaccatgtatatgctgaccattattctgaccatggccgtgctgatctcctggaagttaacgcttgtttcgatcttgccgcttccgtttctggcagccggcattaaagtgctgggagagaaaattcatagacgttttactgttgcccaggacgcctttggggatttaaataaccgggtgctggaatcggttgccggtgtccgcgtcatccgtgcctataaccaggaaatagcggacgaaacaagattccagtcgatgacggaagacgtttatcaaaaaaacattgcggtcgaaaaaattgacgcgctttttaatccgctgacaaaaatcattaccgggatgagttacacgatcggccttgcttacggcacttatctcgtttttcaccagcaaattacactcggaaatcttgtttcctttaatgtctatttgggcatgctgacatggccgatgtttgcgattggggaattgatgaatgtcatgcagcgcggcaatgcttcacttgaccgtgtaaatgaaacgttgcggcatgtggaagatgtaaaagacccggaagccccgaaaacggttgaacagccggatatcatagaatttgccgattatactttccgctatccaaaatcgcgggaagagaacctgaagcatattcatttaaagatcaaaaaaggggagacgatcgggatcaccggtaaaaccggcagcgggaaaacaacgctgatcaaacaactgttgcgcgaatatccgcttggaagcggccggctgcttgtctccggtgttccaattgaacaattgaccaaagaggaagtattaagctggatcgggtatgtgccgcaggaccatgtgcttttttccagaacggtgaaagaaaacatcctgttcggtaccgattcggccggggaagcggaactgcaaaaagcgatccggactgcatcacttgaaaaagatatcgagatgctcccggacggacttgaaacgcttgtcggtgaaaaaggggtcgctttatcaggcgggcagaaacagcggatctcgattgcacgggcggtcataaaagatccggaaattttgatcctggatgacgcgctgtccgctgtggatgctaaaaccgaggcggccattatttcgaacatccgaaaagagcggaaaaacaaaacgaccatcatcgcgacccatcggctgtcggcgattgaacacgcccagtggattgtcgtcctcgataacggccggatcacggaggaaggggcgcacgaacagctgttgaaaaacaagggctggtattacgaacagtatatgcgccaacagctcatgtcccgtgaggaggtggaagcataatggttgcaaaacggcttttccgctatgcgatgaactttaaacgttccattttgattgcgctcgcggcccttatggttgccgttggggcggatgtgttcagcccgatcgtggcaaaaacgatgattgaccgccatatcaccggcattgaaagcgtatgggtggagacccatgatgcccgccaggcggtttcttatcacggccgccattacaaacggcttgtttatgcttccgctgaggagaaaaaagggaagaagcggacgattgtccaggcaggaagaaacttttatttcgtaaaaggccgtgttgaaaccggcgggaaaaatacgtaccgggacggaaaactgtatatgacctataatggcaaaacggcttcttaccgggcggaaaagatatcctatgcgggcgtgctccgcttttacagcccggaaatcccgtatattttgaaactgttaatcttgtatttcggcctttatgttgtgtcgggattcggccagtttacgcaatatttttatttgcaaaaagctgcaaaccggattatccagaaaatgcggaatgacctttttatccacttgcaaaaattgccgatcccattttttgacaacctgccggccggaaagattgtctcgcgcatcaccaatgatacggaagccatccacgaattgtatgtggctgtgctgtcaaactttttcagcggcctggtttatattgccggcatttatattgcaatgtttttgctcgactggaaacttgcgcttgtctgcctgttgttaatgccaattttatggctgtggatgcgggtataccggaagtttgcccagcagtacaaccggatgatccgttcgaaagtgagcgaaatgaatgccatgatcaatgagtcgatccagggcatgccggtcatccaggctttccggcgcgaaaagcaaacgaaggaaacctttgaacagctgaatcggacgcattttaaataccagaacaaaatgctggtgttaaacgccttgtcggcccataatttaaccggcattttaaaaaatctcgtgcttgtggcgtttctctggtatttcgggcacagcgccctttccggtttgtcagccgggctctccgtcggccttttgtatgcctatgtggactatattaaccggctgtttaacccgatcagcaatattgtcaaccagttcagcaatcttgagcaggcgcttgttgccggggaacgggttttcaggctgctggatgaaaaaggcgaggatgtggggacaaaatccgtaccgcgctttaaagggcatgtggagtttcgccacgtctatttcggctacaaagaaaacgaatatgtgctgaaagacattgactttgaggcaaagccgggtgaaacggtcgcgcttgtcggccataccggatccggaaaaagttcgattatgaatgtgctgttccgtttttacgactgcaatgaaggagaaatccggattgacgggacggatatccggtcgcttccgcggcagtccgtccgtgaacatatggcgatcgtgctgcaggacccgtatttgtttaccggcacgatttattcaaatgtcagcctcggggacccgcgcattacaaaagaaaaagcggctgccgtgttaaaagcggtcggcgccgatcaagtgctcggaaatctggaagaagggcttgatgaaccggtctttgaaaaggggagcactttatcgagcgggcagcgccagctcatttcgtttgcccgtgcacttgcttttgacccggccatcttaattcttgatgaagcgacatccaatattgatacggaaacggaattggccatccagcatgccatggatgtcctgaaaaaaggaaggaccacttttatcattgcccaccggctttccaccatcaaaaatgccgaccagattttggtgctggaccgtggccagattgtggaacgcggcagccatgaagagctgatggaaagaaaaggaaagtattatcaaatgtaccaaatgcaacattcaggcggaacggaagcagccgggtaaatcggcatgcgaagcgaatctgtactataacaaacgggcagggaaattctctgcccgttttactgtttctttaattgttcctgcgccatccggaccagttctttcaccatgtttccgccgatcggcccgccaatttttccggcctgttcagccgtcagtttgccattatagcccttttgaagcggaatgccgcgttcactggctacctcgtatttgatatcgtcaggttgatccgtatcagtacgatacccttctttggccatgacttcggttttgaaccggtcaagcgcgcttcttgattctgcgataagcggttttctttttcgttttggcatgcggattccctccctttataggatgcggacggcccgctgcctttatacaccggggagaaaaagcgaaaaatgattttttttaaaaaaatcatacaggatatttaaaatctgtatggaatatttgtataataagaactgtaataatacagcaaatcaaaaagggagtatgcaacgtgaaaaaagcagttattggtgcattgcagatcggtttgctctgggtcatttacgaattcgggctggaagcggtcaaaatcctgcatttgccggttccggggaatgtatttggcatgttggttctgtttcttttattgatcacgggcattttgaagctgcagtggatcgatacgggcgcaacgtggattttaaaacatttatcattcttttttattccgatttccgtcgggctgatgtcgctcggttcatttttcctccataatggcgtggtgctgatcgtaatactagctgtcagcgcggttgccggcattgtagggacagggatgtccgcccaacttttggcaagggggcgtgaggcaagccatgagcagcagttacgccgtgacactttatagcattttcatcaccgttttcgtttacctgttgtcgttgcggttatcgagaaggtttccttccccgtttacaacgcctgtatttttcagcacggccgtattgatcgtgttactaatcgcaacccatgtatcctataaagcgtatcttcccgcaaaaggggtcatgacctattttctcggtccggccaccgtcgcgctggctgtgccgctttataaaaacagggggattcttgcccgctatttcctgccggttgtcggcggcattctttcaggcagcatgctgactgtcgggaccgccctcgccctggccaaaatttttcagctgtcgcacaatatttttgcttcccttgccgtgaaatctgtcaccgtaccggttgcaagcgaggtagcaaaaatcatcggcggcaatgaggtgctggtcgccgggtttgtgatgattaccgggatgatcggcgccatgttcggcctgaagctcttatctttggcgcgcgtccacgacccggtatcgcggggccttgcgctcggcacgatttcccatgggattggaacgggggaagccgtgaaggaaggggagctgcaaggtgccgtatcaggggtggcaatggggatggccgccattttaacttcttttatcctgccatggttgttctaaaccgggataaatatatattacagctaaaggggtagatactgatgatgaagacgccgcttctgctttcttccatgatcgagagggctgaacgctattttcccgaaaaatatgttatttcacggacacacaccgggattcagcggattccgtatcgtgaaattgcaaaacggacacgccggcttgccagtgcgctggaaaaactcgggatgaaaaaaggagaccgggttggtacgtttgcatggaaccaccaccgccatttggaggcctattttgccgtgccatgccgcggggctgtccttcatatggttaacatccgtttgtcagaagaccacctcacccatgtcattaaccatgcggaagataaaattttgctgatcgatgtagatctcgtcccggtgattgaaaaaatccgggatcgcctgaaaacggtcgagcattttatcattatgagcgatgagaaggcgattccggaaactaccttgtttcctgtctcctcttatgaagccatcctggaagaaggcgacgagcgttatccgtttttacacgaccttgatgaacatgcgccagccgcgatgtgctacacgtcggcaacgaccggctatccgaaaggggttgtctattcccaccgcggcctttatttgcacagcatggcgctcgggcttagtgaccagctcagcgttcaggaacgcgacatcgccatgacggtcgttccgatgtttcatgtcaatgcctgggggcttccctatgcagccacctggttcggggcaacccaggtgctgccggggccttcttttacaccggaaattctcgcacagctcattgaaaaagaaaaagtcacgatgacagcaggcgtcccgacgatttggatcggcatgctgaaagtgctgcaggaaaagccgtatgatatcagcagcctgcgcctgatcgtaagcgggggtgcggcatcgcctaagggattgatccgtgcttacgaggaaacgtacaaagtgccgtttatgaccggctacgggatgacggaaacgaccccggttgtttcgttggccacgttaaaaagcagcatggatcattttaccgtggacgaaatggtggatgtgagaggaaaaaccgggctgcctgttcccggcgttgaagtgaaagtcgtcaatgagaacggagaagtaccgtgggacggaaaaacaatgggggaactgatcgtaagagggccgtggattgcggatgaatattacaatgacgagcgtacgcaggaagcattcagggatggctggctgtataccggagatattgcagtcgtggatcaggaagggtacctaaagattaccgaccggacaaaagacctgattaaaagcggcggcgagtggatttcttccgtcgaacttgaaaacgctctcatgtcgcacgaagcggtctttgaagcagccgtcattgccgttccccacccgaaatggcaggaacgcccgctcggctgtgtggttttaaaaagcgaatatgaaaacaaaatcacggctgcggaactaaaagattatttaaaaacacaatttgcctcatggtgggtccctgacgacattttgtttatgaaagaaatcccgaaaacgtctgtcggcaagtttttaaaacgggcattgcgtgaacagctgcaagaccattatgcaggcgtgcagtaatgcatgcgggaaaaagccggaatctttctatggatttcggctttttcattcgataatataaaggggagaggttttaacggaaagacgaaaggattcaaacggaaatgcccaaaacatggaagaaaaagaagcggaaccggggtaaaacgtggatcgtcctgcttattccggtcatcgtgttaagcgcctattttattttcgaagagaacatccagaaaaaaacggatccccaaatccctgaaaaatatttgtccatctatttggaagcagagaaaatatacggggttccctggtatgtgcttgccgctcatcaccgggtggaaaccaggttttcaacgatgaagccgatggtctcgccggccggcgcccaaggcccgatgcaatttatgccgtgcacatttgtcggctggaaacatccgtcatgcagcggccttggaaaaggagacatcccgaaaaatgaagaaacgaacccggctgtcataaaaaaatacggaggatatggcgtcgatgcggacggggacgggaaagcagacccgtttaacgataaagatgcgattttcagcgcggcaaattatttgtcgaaaaacggggcggcaaacgggcagattcaaaaagcggtttttgcgtataaccacagccgtaaatacgtgtccgaagtgatgcattatgtacacctttatcaaaaagaaggtttagaaaaagcaagcaagtaaaaaagggcggttctggccgcccttttttactgttatgcttttcttgctattcttaaaatgaagcttaacacaaagacgagaatgatggccccgattaaagcaggtatgatggccatccctgcaatatgcggcccccaattcccgaaaattgcgccgccaagccatgcaccgacaatcccagcaataatatttccgataattccgcctgggatgtcccggcccatgatcaatcctgcaagccatccgataatcccacctacgattaaatatagaataaacgacattttcacattcctcctgttaacttaagtttcatgtctttttatcgaacttggtgtacttattaccttttttgtaccagactaaacatgcgcaggcgtattctaaaacgtctaaaatgacaaatatgcggaacttttcaggggaaagcgggaaatcctctggtttgaagtttatagatcatgcccgggattgtgcttttgccttgaatgattccggtttttaaccttttttgagccgcttaacggttccggctgcccgctgttgtttgcttttggctggtttctgcgtatatcatttccgtcgtttttatttaccattttcatccctccaactatacaatttgctttttgtaaagcggttatacagcataccatgaaaaaaattgaacatactatcgtttgaaggagagatgacaatgccttaccataaagacaaacagcaggcgttccaagcggccgagcagcacatggccttgacggaagacatcttgcagaatgtagagatgggaagtgaagacgccgggcaccagctcgcccatttgaaagaagaaatcaacgaaacgtaccaagagatcgaaaatgcactcgaagtggcgagcgaaacgcaacgggtgcaattggaacagttccggcgcgatttggatacaatcgtaaaacatacagatttgcattaaagcggggaggaggatccctgctttttttcatctgcgcccggatctggtataatatagaatggtatcaagcctgcgaccgggcggggttcatacatatgaaaaataataaacaggagggaatcgaaatggctttgccaaattttgaacagaatttacaaaaatatgcgaaattgctcgtgacaaagggcatcaatgtaaagcagggcgactgggtaaaagtatatattgcagtcgaccaggcaaaacttgcgcgccttgtcgtaaaagaagcgtatgcactaggcgcggaaaaagtaatcgtcgaatggtcggatgatgaaattacaaaacagcattatctgaatcagccgcaggaagtgctgacacatattccggattacaaaattgccgagacggaagaccatgtgcttaaccataaagtgagccggctgtctattctttcaagcgatcccggcctgctcaatgatgtcgatccgcacaaagtggccgcttatcaaaatacagcagcgaaagctttcaaagcgcagcgggttgccacgcaaaatgacgatatcaaatggacggttgctgcagcggcgggggccggatgggcaaaagcagtattcccggatttagaaaccgaagaagcacaagtcgatgcgctttgggatcagatttttaaaacatgccgtgtctacgcggacgacccggttgccgcctgggaacagcataaacagacgttaaatgaaaaagcggcgaagttaaacgacattcaattcgatgcccttcattatacggcgccggggacggaccttacactcggccttccgaaaaaccatatttgggccagtgcgggcagcgtgaacccgaaaggcgaagaattcattgccaatatgccaacggaggaagtgtttactgcaccggatacgcacaggatggaaggcgtcgtgcgcagcacaaaaccattaagttatgcaggcactttaatcgaaggcattgttgtccactttaaagacgggaaaatcgtcgatatttctgctgaaaaaggcgaagaagcgatcaaaaaactcgtgtttgaaaacgagggtgcaacagggctcggggaagttgcgcttgtaccggatccgtcgccgatttcacagtccggcattacatttttcaatacattgtttgacgagaatgcctcgaaccacctggccattggtgcagcctatccgacaacgatccagggcggcacgaaaatgagcgaagaagaactgttaaaacacggcatgaatgtctccaatgtccacgttgacttcatgatcggctctgctgatatgaatattgacggcatcaagcaggatggaaccgttgtgccggtattccgcaatggggactgggccatctaaagaaaaacattaatattatattgataaagattctcaatggccaaaacaaagaaatcagcccataaagctgatttctttgccatcccatgctactggtttttcttgcgttttttgttaaactgtctttctttttccgttaaaggctcgtttgaaaattcttcattgtatccggcgcctttcccttgcgcttttgccgtattcatgcccggccggatatggtttgctttctgtcttgtcacaaggctcacctccctggccacagtttcagtatgttgaataaaggaaaaatcataccttgccgataaattttttgcaaaccaaacgacaggtgatataattaaaacttatcacacacaataatattattgttatttacttatgtcatttcttgtaataagatgaaactgtgaggcgttttttacgaatcattctgttaatcttttaaatgatgaaaatatgaatcttgacaaagggggaaaagacatgtccaatgatgtctttaaagcgcgttccatttttgaagtaaatgggaaacgctatcactattaccgcctaacagcgctgcaagacgcaggaatcgccaatgtgtcgcgcctgccttattcgattaaagtgctgcttgaatcggtgctccgccaaatggacggccgcgcgattacgaaagaacatgttgaagatttggcaaaatggggatcggatgaagtaaaggacaaagaagtcccgtttaagccgtcacgcgttattttgcaggattttaccggtgttccagttgttgtcgatcttgcatcgctccgcaaagcgatggctgatttgggcggaaacgcggataaaatcaatccggaagtaccggttgaccttgtgatcgaccactcggttcaggttgataaatacggtgcgccggatgcccttcaggtgaatatggattttgaattcaaacgcaatgccgaacgctataaatttttaaactgggcccaaaaagcgtttgacaattaccgtgccgttccgcctgcaacggggattgtccaccaggtaaaccttgagtatctggcaagtgtcgtccatgaaaaagaactggaaaacggcgaatatgaaacgtatccggataccctcgtcgggaccgattcccatacgacaatggtcaatggactcggggtgctcggatggggtgtcggcggtatcgaagcggaagccggcatgctcggccagccttcgtatttcccaattccggaagttatcggcgtaaaaatgaccggatcgcttccgaacggggcaaccgcaaccgaccttgcgttaaaagtcacccagcttttgcgccaaaaaggcgtggtcggcaaatttgtcgaattctttggcccgggcgtctcaacgctgccgcttgcagaccgtgcgacgattgcaaacatggcgcctgaatacggggcaacttgcggtttcttcccggttgacgatgagtcgcttgcctatttgcgcttaaccggccgcagcgaagaacatgtaaaagtggtggaaacttacttgaaagaaaacggcatgttctttacgccggacaaagaagacccggtttatacggatgtgcttgaactgaacctttctgaaattgaagccaacctttccggcccgaaacgcccgcaggatttgattccgttatcgcaaatgcagtccgctttccaaaaagcgattacggcgcctgccggcaaccaaggtttcggactggatgaaaaagagctcgataaagaagctgtgatccattttaacaacggcgaaacagctgcgataaaaaccggcgcagtcgccattgcagcgattacgagctgcacaaacacttcaaacccttacgttatgctcggggccggcctgcttgcgaaaaaagcggttgaaaaagggctggaagtgccgaaatatgtgaaaacatcgctcgcgccgggatcaaaagtcgtgaccggctacttaaaagactccggtttaatgccgtacctcgaacaactcggctttaacctggtcggttacggttgtacaacctgtatcggaaactccggcccgttgaaggaagaaattgaaaaaaccattatggacaatgatttgctcgtaacgagtgtcctttccgggaaccggaattttgaaggccggatccatccgcttgtcaaagccaactatctggcttcgccgccgcttgtcgttgcttatgcgctcgcaggaacggtgaatatcgatttaaaccatgacccgatcggcaaagacaaagacggccaagacgtctacctgaaggatatttggccgcaagcggatgaaatcaaagaaaatgttcaaaaagtcgtcacgccggaactgttccgcaaacaatatgaaaacgtctttaccgacaatgaacggtggaatgcgatcgaaacgagcgacgaaccgttgtatacatgggatgcagaatcgacttacattcaaaatccgccgttctttgaaaatctctcgcctgaaccgggcgaagtacagccgctgtcgagcctgcgcgtcatcggcaaattcggcgattcggtgacaacggaccatatttcgcctgcaggtgcgatcggcaaagacacccctgccggaaaatacctgttgtcaaaaggagtcgaaccgcgtgactttaactcttatggttcccgtcgcggcaaccatgaagtcatgatgcgcggaacatttgccaacatccgcatccgcaaccaaattgcaccgggtacggaaggcggctacacgacttactggccgacgaatgaagtgacgtcgatttatgatgcagccatgcgttataaagaaaacggcaccggccttgtggttcttgccggcaaagattacggcatgggctcatcgcgcgactgggcggcaaaaggcacatacctgcttggcattaaaaccgtgattgcggaaagctttgaacggatccaccgttccaacctcgttctcatgggcgtgctgccgctgcagttcaaaaaaggggaaaatgccgacacactcggcttatccggcaaagaaacatttgatgtccatattgacgaaaatgttaaaccgcatgactggataaaagtgacggctaccgacgaaaacgggaagaaaacggaatttgaagcgcttgtccgtttcgattccgatgtagaaattgactattaccgccacggcggcatcctgcaaatggtgctgcgcgaaaaactacagcagtccaaaaatgaagtgaaatcaaaatcataatgtttaaaaaagctgcggccaaagccgcagctttttttgaatcaaatttataatttttcccataattgcccatactaagtaaaaatacttgtaaggagtggcaaatatgagaaaaacccataaaaagaccctttcggatcttgttgccgaaaataaacaggaactgttgcgcgacagggatgcgctgatgcggatagaagaacggctggaccggaaacacgagatgaaattagcagaataagccactgtttgtgaatcataatccgctttcctcctggggaaaatgtataaggaggggggagatatgatgggcaacccaaacaagaaaagcaaatatttcgttcccgatcatcttggcacgcagccgcgcggattttccggcaataaggggaagaagatgcaggaccgttcgggacagcacgcccaggtgatacagacaaaaggggagtagctttcacagccgaaggaggagaacacaatggcgcataaccgaccgaaaccggacgaccgcagcgataatgtggaaaaactgcaaaacatgatccacaatacgatcgaaaacatggaaagcgcggaagaatcgcttgccgttacaagcgatgaaacgcaaatccaacaaataaaggaaaaaaatgagcggcgccgtgaaagcctcgaagcgatgagaaccgaggtaaaagacgaagccgcatacaaacagcagcaataaacgaaaacggcctttcgacggaaaacagcagcgtttctttggaaccacgccttttccctctcggaaaggccgttttttctctccttttgctgcgaccatgcgtgcatccgaagttttcccggccccgtatcaggcatccttttaggagggggaattttctttatgctaaaataaaattgactgtacatatgaaagaggtgtccgggatgtttgtatcagaaacagaagtcaaagtgcggtatgcagaaacagaccaaatgggggttgtgtaccacgccaattacctgatttggatggaagtggggcggacgaaattaatcgaagaccttggcttccgttatgcggatatggaaaaagacgggattttgtcgccggtcatcgatattcaaatttcatacaaaaaaccggcccgttacggggaaacagtgaccgtaaaaacatgggtcgatgcatatgacgggctgcgcgtaacgtacggctatgagatttacacagaaaccggcgaccttgccgtggccgcgagttcaacacatgtctgcgtaaagaaagacagcttccgaccggtttcgttccgccgcctctacccaaaatggcatgaagcatatgaaaaagcaaaaaaatcataaagcggggggatggatttggcttttggcatacaccgcaaccagcttaaagcgtggaaagcggcgattgaccgcggggagattgcgtttttaacgcatttttggctggacgaccgtttccccggcgcaaaatcggtcacaaaagtcggctgtaaagatctggagaaactcgctgcatggggagcacgctaccagctgaaaaaagaatggattcatgtccgtaaagacggttacagccatttcgacctgcttggcaggaagcagcgagaaattttgcaaaaagaagggcgccttgcggaagtaaaaaaatttttaaaatgaaaaaccggcatcactggcagcaaaaaagcaaaagctgccggatgatcccggttttaaccttttttatattcatataccggttcatcccgtttcgggtcatacccgatatacaaatcatggccgtcaaaataccattcgtccgtgccttcaatgaaaaaagcatggccgttccgttcaacggccgccaccggatcgtcgggaacgtctttttgaacaccaagtgaaaacccgtgttggacaggcgtggagccgccgtatttggcaaaaaaacggacggactcgccgtcgtccagttccagttcccttttaaaccagtttactgcctcatctgtaatgtgcattttcatgccgccacttccttccaactgccttttacattttcattatagaccaaagcacgtttttttccctaaccttttgccttcgtttaccggccccgggttataggaaacatcagatttagaaacaatggctgccttacagccacttgacttttggctcggtcttatttttaatccgcttaatattggctttatggcggtaaataatgaaagaggcaagcgccagaacgatgacgaacagcggccagtcatgtgttacaatcatataaatgagcgtatacaggatgccaaaaacagccgccatgatagaagaaagcgaaacgtatttgctccattttaatgtaatcaaaaaaacgatgatgaccatgacaaacaatggccattgataggcaagaacaacgccggcggaagttgccaccgctttgccgcctttaaatttggcaaataccggaagcatatggccgataacagcgatcatcccgattaaaagcgggtgcaccgtatgctccaggccaaaaaagtggggcaataaggtggcgattgtccctttcagaatatccaccactgttacgacactgccggctttgaacccgagcacacggaacgtattggtcgcaccgagatttccgctgccgtgttcgcggatgtctataccgtaaaaaagcttaccaacgatcaggcctgtcgggattgagccgagcaggtaagccaaaaggatcatcaggacaatattcatgtacaaaactccttggaaaaaatctatgcttattgtagcatgttcttaaaggaaagaggaatattttttgccgattccgtgcagattttctaaccgagcaggaattggaaaagatcaagcgaatgtttaagttgggatcagactggcgaaagtacaagacaaattggtctgtgttgcgacaaaaaattttcacatcccgttcgcacggcttcataacaggacttaagacacaatatatacagtatatcggttaggcagactgtacatttatagttcttttgcattataatggtattaatttgaccggtttttaacatttttacgtctcccgtgcagttttttgttttaatattcttcattttcaaggctcgcgctttttatgcgtttttcgcttttatacggaaacagggtcagggtgattaggaaatggaaaagaaagaaaatcatttaatcctatattataagtcccgtttactggatttaatgaatcttgagacagcaagtagcctggatgactgggtggcggtcgtggcagaagtgctcagcgctgatcatatcgtgtattataagccggacagcgagaacacaaagttttacaaaatatgcggcttttacaatcctttccggcatgacgtcgaacttgtcgtgccatccggaaaaattaaagctttaaaaacagcctcccaggttgtcacaaatgggaaactgcaaaaggatccttatttaaaacagtttaacattgctttttttattccggaaaaaaacatggaggatggctgcctgcttctttccattccaaacaggatgttcggggagctgtctgacgcggatttgcaggcgtttgtcagggaaagccggaacttcctgcagctgaagtatgagttgtctgttgtcgaagccgacagaaagcgttacatcgaattattccaagtgaccggaaaattccattcttccatggatacggatacgatccttgcagaaatcatttacacgctgaaaaggctgtatccggtttttgaatacaccttaatgctgtcggacgattatcaccacaatcttgatttgccgatcaaatcgctgcaatatgatgcggtcgacgaaatggcgctcgaatcatatgtaaacggccaggtccatcttgccacggtatggcggacaaacgaaacgatgctttatgcgccgctaaggggaaagcagggcgtgtacggcgtgttgcaggtcatcacttttgccaactatgaatttaaccgcagcgatctggaatttatcagcctgctcgccaatacggcgggaagtgcgcttgagaatgccaagctgtaccagcagtcgatgcagtccattgaagaactccgcctgatcaattcggtttcccgccagttaaataaaagcgcgaatttaaaagaaaccgtcgattttttaatggagcagatctccagttcatttgatacccaggcaatcgggttcgtgatgatggagaatggaaaaatggacctgcttgaaggcagcagccccatttttgaagaaaaggaaggcatccggtatcttgattttgcaaaccgttcttttgctgatacgaaagaatccctgtttatcagcaacttaaaccagcgttttcccggcagaaactattgcttttcttcgctgatggctgtcccgattatccaggaagatgatttaaaggggttctgccttgttcttcatgaagcgccttaccatttttcttttgacaggttcaaactttttcagtcgcttatttatcaatcgggcatggccttaaccaactccatgcttcgcgagcggcttgaaaaaatggtgatcaccgaccatcttacccagctgtttgccaaaaattacttgaacagccggatggaaacttctatcggtgaagatgagcagggcacgctgattttgctcgatattgacgactttaaaaaagtcaatgacacatacggccatcaagtcggggatgaaattttgatccaggttgcaaagctgatcaaagaaaacattcgttcaaccgatatcggagcaagatggggcggagaggagatggcgatttatcttcccggcgtgccgcttcaaacaggggtgcaggtcgccaaaagggtgcttgcggctgttgagaaaaatacaaatcctccggttaccatttcgtgcggggtgtcgtactggaataaagagatgaatgaaacggtggaatcgctttttaacagggcagacgccggattgtatcatgcgaaaagcctcggaaaaaaccaggtggtcatcagcgatatggaaatgaaagccaattaagggcgcactgcagctgattgcttttgtacagccgccttaaaaaacccccattgcctgatccggcaatgggggcattttttatccattcggttatggttttaatatctgcttcaggccgcttaatccttgctgcctgccaagttcgtccggcctttgggactcggcatgcttttatctccttatttatcaacctgcgaaaccggccttacagcactttttccagcgctgcggcaaaagctgccagtcccgcttcatcttctgcatcaaatcgatttttttccgggctgtcgatatccaaaacgccgatcacttcaccgtttttcatcagcgggacgacaatttcggattgggaagcggcgtcacaggcaatatggcccgaaaactgctgcacatcggcgacccggagcacccgtttttctttccaggctgtcccgcacaccccttttccatacggaagccgtacacaagctggcaaaccttggaacggcccgaggacgagttcatccccgcttgcgaaataaaacccgacccagttcacccggtcaagaaactggtttaacagcgctgcagcattgcttaaattggcaattttatccggttcgtcttctgtgagcgcgatcagctgttttacgacaagatcatacttttctttcttcgttccctggggattttctgcatgaaacatcgccatcatccttacatcagcaaattttttaaaaacggggcgggattttgtcggaaagtttttaaaggaaccccggcccggcatatggaatagtacggaatagaatatttttaacacaaaaggggaagcccggcaagcaaaaaagaggaaagggtggaacaaatggacggaaacagcagtgaaacaaaagaaaaaatatttaatacggcgattgctttatttcatacgaagggctataaaggaacaacaatcagggcgattgcggcttccgcaaaagtcaattcggccaatatttcctattactttaacggcaaacaggggctattggaagcgtgttttatccgcttttttgaaccgtatattgcctgccttgaagaagaagtgcaaaatctttcggaggatggattaaaacgggcggccttccgcatcctgcactttcaaagcgaaaaccacctgctgtccagatttgtatggcgggaagtcaccattgattcgcaaattgtccgcgaaattttgtccacttacttcatgaaagagcgttatttattaaaaaagctcgtcaaagcctggtgcggtcccggaatccaggcgggcaaactgaactttctcatgatccagctgaaaagcatgctgtcgatgccgtatttaaacagccagtatatccgcgaagtatggggcatgcagccggaagagccgtattttgccgaaaaatacggcaaatcggttgccgaatggctggacagcatccggcaaaacgcgggggcgcagccggaaccgctgctgcttgaaaccgctttttaatggccggagcgggctggctgtttttaaaatgccggcagctttccgaaaaagcccgccgacgtgcaaaaaataagcgccggctttttttattgtgggtacggaaaaaaccttccccaaaatgaatcgaaaaatctcgaatttcatagtcaaatattgtcattacatggtatcatagaataaaaataaacatacatgcctgtgggtatcgggaaggattgttccggtattcatacatacataatgagcggatattaaggtttgatttgtggacgaacgggaggctttcaagtttatgatgtatggcatcattggcgctattcttttattgctggttttattgacttgcggtttttttatcaggaggcagttttacaaagagattgacaagcttgaagcatggaaaattgaaatcatgaaccggcctgtcaccgatgagctgggaaaagtcaaacggctcaatatgggcggggaggcggaaagtttatttgaaggctggcgcaaagactgggaggaccttttaaacgaggaactgccggcagtggaagataagctctttgaaatcgaggagcacactgacaaataccgtttcaaaaaggcgaaggccgtacaggcggaagcagaggcgattcttcaaactgcggaacaaaaaataaaagatatactggacggcgtcaatgaactgatggatgccgagaaagaatcccggaaagaagtggaagaactcgggaaaatcttcaaagacttgaagaaacagcttctgacacggcgccatacattcggaaaagccattaaaagcctcgacctgagagtggacagcctggcggagaaatttgtccgttaccatgaattgacggaagccgggaactatttggaggcaaagaaattagccgatgaactgaaaactgaaacagaaacattgcaggaggatgccggaaaaattccggatttgctggcggaaacggaatcgcttttgccgatgcagtttgctgaattgaaagagggctacaaagaaatggctgcacaaggctttgcgctcgatcacctgcagtttgatgaagaaatgaaggagcttacagaaaagctatcggcttaccggaaacaacttgaacaggctgacacagcggatgtcgaggaaggcatccgggaaatcaaggaaagaatagaaacgatttacgatgttttagaaaaagaagcgtacgcaaaaaactatgtgctcaagcatttccgcgaagtgaaggatatgctggatgaagtacgggaagaaaacaagcgcctcacaacagaaacagaatccgtgcaaaagacataccaactgcatgaggaaaacatggccgttcctgctgaactcgataaacagttggagaaactggccgcgcgtttggcggtccttgaagtaaaaattcccgaaaacgaaacgatttataccgtgttaagcgaacagctcaaagaaatggaagggcagattgaaaaactgcaggatgaccagaagacgtttaacgaatttctgcagaacctgcggaaggaagaaatggaggcacgcgcgaagatcgcgggattgaagcggaaaatccaggatatgcgccgccttgtcgaaagaagcaatatccccgggctgccggactcgtaccgcagcctgtatgaagcggcctggaacgcgattcgtgatactgccgacagcctccatgccacgccgctaaacatggagagggtcaaccaccatctgctggaggcggaacaggcagtcggaaactttgaaaaaagcacgaaagctttattggaaaatgttcagcttgctgaaaaagtgattcaatacggcaaccgttaccgtgctaaatataagaaagtggcggacgggctggagcgcgcagaagtagctttccggcgctatgattatgagaaggcgcttgaagaagccgcaacgacagtggaggcggttgagcctggtgcattgaaaaaaattgaaaaaatgctggaaacggaagaattactttaaagcaaacggaaaaaatacggagcgctccccgtttttttcgtttgcttttttccatgcctttcagccggacgcacgcattcgttttgacgccgggttctttagcctggtaaacaggtacgggtgaagacctttgagccttaagcgacgcatttctgcctgaacgggttaaccacgcacgggcggaaggcgcaggaccattaccaccccattttgaagattaaagccggtgccgcaaaaaagcggcagggagaccggaatgggtgttgcataacgggagtatatcggttgtaggttcggtatccggcatggtatattaagcaatgatgcaggtttggatccaattttatgccaacagagggtgttcaaatgatttactttgacaacagtgccacaacgaagccttatccggaagtgctggatgcttttgtgaaaacatcggaaaactattttgcaaatccctcttccctgcacagcctcggcgcgcgtacagagaaacttctcacgcaggcaagacggcaaattgcaggtattctcggcgcagacgagaacgaaatttttttcacatccggcggcacggaaggcaataatctggccattaaagggacagccctcgcataccgttcaagggggcgccatatcattacgacggctgttgaacacgcatctgtttttgaaacgtgccggcagctggaagaatggggctttcgcgtcacgtatttgccggttgacaagagcggaaggatcaaactggacgatttaaaacaggccatcacggatgaaacgattcttgtttccgtgatgcatgtgaataacgaagtcggaacagtgcagccggtggaagaaatcggacagcttctgaaacattacccgaaaatcctgttccatacagacgatgtccagggctgcggaaaagtcccgctttccctgcgtgaggccggcatcgatctttgcacggtttccgcgcataaatgccatggcttaaagggaaccgggatattatataaacgggcaaatctccgcctgtcgccgcttttaaccggcgggcaccaggagagcggcttgcgcagcggcaccgaaaatacaggcggaatcgttgcagccggcaaagcgctccgcctgatccatgaaaaatttgaagcaggggcggcagaaagaacggcccgtatccgggatgccctgatcgaaaaacttcaggagatgcctgctgtaaccgtccataccaatccggctgtttcagcaccgcacatcctgaatttttccgtccgcggcatccgcggtgaagtgctcgtgcacgcgcttgaagaggaaggcatttatatttcaacaacaagcgcctgttcttctaaaacgcgggaactgagccgcacgcttcttgccatgggggtttccgaagacgaagccgaatgggcggtgcgtgtgagcctttcttatgaaaatacaatggaagaagcggaacgttttatccgcatattaaggcaaacaaccacaaatttacaacaagtgttggggagaaatcaatgaactatgaccgcattttaatccgttacggggaactttcgacaaaagggcataaccgccagttttttatccgccatttaaaagacaatgtcaaaaaagcgctcaggccttttcccggcattgaagttcaggcactgtacgaccgcatgtacgtgcttttacatggcgcagatggcgggcaagtcatcgacattttaaaatcgatcttcgggattcagtcgttcagcccggccgtccgcacccggaaacagctcgaagacatcgagcaggcggggctcgaactcgtccggcaaaattttgcgaaaggcaaaaccttcaaagtgtcagcccgccgcggcgataaaacatttgaatacaattcgaatgatttgaaccatctcgtcggcggctatattttaaagcaactggacggcattcaagtcaatgtaaaacagccggatatcgagctgcttgtggatgtccggaaaaacggcgtttatttgtccactgaagtgataaaaggatccggcgggcttccggtcggtgcatccggcaaagcgatgctcatgctttcgggtggtattgacagcccggttgcaggatacctcgcgatgaaacgcggcgtgaaagtggaagcggtccatttccacagcccgccgtttacaagcccgcgtgcaaagcaaaaagcgcttgaccttgcgcaaaaaatttccgcctacagcggctccatgaaagtgcatattgtcccctttacaaaaatccaggaaacgatccataaaggggttccggaaggctattcgatgaccgtgcagagaagggtgatgcttgagattaccgaccggctccgtaaaattcataacgggcttgcgattgtaaccggcgaaagcctcggccaggttgccagccagacgctcgacagcatggttgcaatcaatgatgtcacaacgacaccagtgttgcggccgcttgtttcgatggataagctggacattattgatattgcccaaaaaatcggcacatacgacatctcaagccttccgtatgaagactgctgcacgattttcacgccgccttcgccgaaaacacggccgaaactcgagcttgcgcgtctttacgaaagccgcctcgacctggaaccattgattgaagaagcggtgcaaaatacggaggacgtctttattacaccaaatgaaacggcgcaggaagaagatttttctgagctgttataaaatccagtaattggcagcaccgccaataaacttacaacatgatgccatgtgtttatgcgcaatctatactcacaaggaggtgagacacatggcacaaagcaacaacagcaaccaattgcttgtaagcggtgctgaacaagcactggaccaaatgaaatacgaaatcgctcaggaatttggcgtaaaccttggtgctgatacgacttcccgcgcaaacgggtctgtcggcggcgaaatcacgaaacgccttgtttcgatggctgaacaacaattaggcggtacttcccgataactgaatgaagaatggatagagaagcgggcctgaatcgggtccgcttctacttgtttttggcgtaaatttgtatcatatttttttaatatcaggtataataatgaggtactaaaaaattctggaggcgattcgcttgcgtcgtagtgacctgattgcgccacaaacatacaatatagccgaagaaattgagaaatatgcccgggacccgcacaaagttgcgctgatttgggaagacaaagaaggcatgcacagagaagtcacatataaagaattaattgaaaatgcaaaccggaccggccatgtctttttggaaagcgggctgaaaaagggagataccatacttgtcatggttccgcgtattgtagaagcatacgaagtatatctcgctgcaatgaaatgcggcatcgttcttttgccggcatcggaaatgctgcggacaaaagaccttgactaccggatcgaagcaggggatgtaaaaggcgttgtcgcccattattcatgcactgcacagtttagagatgtacgtggtattgaaaatttggaaaaattcgtgattggagaaccggaacagggatgggcgttcctggatgaaaagaaaaaagcagccccttgtgaactggaaatcttcaaaacgtcaaaagatgatatcgccattttgtcctatacttccgggacaaccggcaatccgaaaggcgttatccatacgcacagctggggatatgcccatttgcgcacggctgccccgaactggcttggcattcaagaaggcgaccgtgtttgggcgacggccgcaccgggatggcaaaaatgggtgtggagtccgttcctttccgttctcggttcaggcgcaatcgggtttgtttacaacggccgttttgaccctgaaaaatatttgtcccttttagatgaatatgaaatcaatgtgctctgctgcacaccgactgaataccgtttaatggcaaaagtcgatgatttgtcccagtatcatctgaaaagcttaaggagcgcggtctcagccggagaaccgctgaaccgcgaagtcatcgatgttttccaaaaccatttcggcatcacgatccgcgacggttacggccagacggaaagcacgctgctcgtcggttattcccttgatacgccgttgcgcccgggttcaatgggcaaaccgtttcccgggaatgaagtcgaaatcgtaaatgatgacgggaagccgtgcaaaccgggtgaaaccggcgatattgccgtccatagagacacgcctgcgctttttaaaggctattataaagagccagagcgcacggccaagcagtaccgcggcgattacttcattacaggggacagggcaagaaaagacgaggacggttatttctggtttgaaggcaggcgggatgatatcattatttcttccggctatacgatcggaccgtttgaagtcgaagatgcccttgtcaagcatccgtatgtgaaagaatgtgccgttgttgcaagcccgcacgaaatccgcggcagcattgtgaaagcttttgtcgttttaaaagacggcatcagcgagaatgtgccgggtcttgtaaaagaactgcaaaaccacgtcaaacaactgaccgcgccgtacaaatatccgcgtgcaattgaatttatcaaggaattgccaaaaacggcctccggcaaaattcgccgtgtcgagctcaggcagcaggaatggaatagataagaaacgaaaagccgggcattttttttcaaaaaatgcccggctttttgttttaatgtcccggatcttcaagtagaataaaagaaaaaccaaaaaagtggaaggatgaaatgttggcatgaacaaaaaaagatggggagcgcttgctttggcaggcgggctgttcgtcgtttccattattgtgaacttggcgagcatggcggcatcaaccaacttttccaaaatctttaaagagaccgtggaagctggggaaggggatgtttccgaaaatgtattgcaggatgggaatgagtcaaagaaaatcgtcgtgctgaatgtgaacgggacaattcaggataccggcacgacaccatcactgcttgacaccggtgaatataaccaccaaagttttttgaaagaactggatcaggcgaaaaaagacagcgatgtaaaagggatcattttacatattaattcaccgggcggcggggtggccgagtcggcagaaatccatcaccatctgatggaaattaaaaaagatacgaagaagaaaatttatgtgtccatggggccgacttgcgcatccggcgcttattatatttcaacgccggccaataaaatattcgcaagtccggaaacattgaccggatcgctcggggtgatcatggaaagcgtgaattacgggaagcttgccaaaaaatacggcattgattttcctgtcatcaaaagcggggagtataaagacattatgagcccttaccgggacatgacgaagagcgaaaaagaaatgctgcagaaaatggtgaacaattcgtataacggttttgtcaaagtcatctctgaagggcgccacattccgaaagaacaggtgcgcaaaattgcggacgggcgtgtatacgacggcaagcaggcgctggatttgcatctgattgacaaatacggttacctggatgacaccattgcggcgatgaaaaaagatcttcatctcggaaaagcacaggttgtggaatatgaatcaagtggcgggtttgggtcgctgttttccgcctcagcgcaaaaaatgctcggcaaagaagcagaagcctcggggcttgcacgtttattgtcgcaatcgaacgcaccgcgcctgatgtacctgtattccggggctgagtaaggggggagcttgaatgaattcaaacgaaaaccaaatgcctgaaacggtgaatcccgggacggaacaaaaacgcgaggagttattcggggcccgttatgccgggttctggatgcggttttgggcctatttgcttgatctgcttgttgtagtaagtgtgaagtggctggttatccatcccattttccggttttccggcttgtctctcacagaagataaaatttatgcaccgattacggtggcatcggccgttgtattttacgggtactttgtcctgatgacgaaatttttcggccagacgcttggaaaaatggtatttggcctcagggttgtgccggtgaaccatcccggtccgctgaaatggagcaccgttttattccgggaatggatcgtccgttatgtttgtgtcaccatttcggccatctatattatcgttgcatttacgccgaaaaaacaaggggtgcacgatttgtttgccgatacggtcgtcattcatgaacgttcccaggaaccggtctatccttattatgaacctgcttaaaggcaggtttatttttttgccctgttggcgataatgatggcaaaaaaggctgatgatggaaatgacatggtggctgtccgcggctctcggcattgccgcaatcgttgcggttctttggttctcttccctgtccgtcctcattgaatacgggcaccgccgggatgatgataaaatttttattcaaatcagggtttggggcatcatccgctataccgtgaaaatcccggcagtgaaagtggacaggaaaaaacccggcgtcgtatatgaaaaagagacaaaacatgcagagtatgaaaggagcattacgccggatgtgctcgaacagcggattgaagatgtgaaacaaattgcggagcgcgtcatcggtttaaaggcgattgtaggcaagttcatccgcagtgtccagttgagaaaattcgaatggcatacagcaatcgggctgcatgacgccgcgtggacgggaattgccgccggaagtatttgggcggtaaaagggggaatactaagcctcataaccacaaatctgcgggtaaaaacggatcctgtcctctctgttacaccctttttccaaaatccggtttctgaaacgcagttaaaatgtatggtgaaaatccagattgggaaagctatactggccgcatttaaagtgttgaaatactggcggggaggaaaagcggaaatcgcgcttaaaccggtttccgaatcagaaaacggccggcatgcttaaatcccggcagaaacgaatgacaggaggaaacaacaatgggttcacatccgattgaaggcctgatgacggccgcaatggaaaatttaaaagaaatgattgacgtaaatacgattatcggggatccggtggaaacgccggatggaagcgtcattttaaccgtatccaaagtcggttttgggtttgcggcaggcggaagccaatttaacgggccatccggatccggcggcagcggtgaatcccgtccggcagagctgcctttcgggggcggcagcggcggcggtgtctcgattatgccgattgcctttttggttgttggcgcacaaggcgtgaaaatgctgcacctggaccaaaacacacatttgattgaaaaaattatggatgtcgcgccgggcgttgtcgaaaaaatccagggcatgctgaaacaaaacggccaaaatgcaggcggccaaaatggcgggcaacagccggccaaccagcaaaaacaggatcttgatttttaacaacccgcatgattcgcgggttttaaattggaaatttttttcgttgtccattatgatagggtatgagcacagttgaaaaacgggggattgaaagccccggtaaaaataaggagggtatctcatggcttcggttacatttaaaggtaatccagtcacattggaagggacagaagtgaaagtcggcgataaggcaccggactttacggttctggataatgatttgaatgaggtgacattttcggatacaaaaggcggcgtccgcatcttcagcgttgtcccgtcgattgataccggtgtttgtgatgcacagacgcgccgttttaacgaagaagcggcaaaactcgggaaagaagtcaacgtttatactttttcctgtgacctgccttttgcgcaaaaaagatggtgtgcggcatccgggcttgaccatgtaaaagtgttgtccgaccaccgcgacctgtcattcggcaaagcttacggggttgtgatgaaagaacttcgcctgcttgcccgcgccgtatttgtcgtagattccaatgatacggttacatatgtggaatatgtaagcgaaggcaccaaccatcctgactacgaaaaagcattgcaagccgcaaaagatgcagagtaaaacaggtattcgcgtcaagaaaagcgaagagcacttgctatactgcgataaaatccccgatctccatcggggattttatatggaagaagaatacgaaggaggagcatgaatgtcggactctcctgttgaaaccctttttaacgttttaaacgaatccgcacacattttggaaaaccgcctctctgttccgtacctggaagctgtggcgatgaccggggaaaacttattcagcggaagcatccgccaaaatgggatcggtgcgcatgatgaaaaccgccttgaaaacctatacggaacggtccgcctcgaggattttacccgcgagcagatccggaaagcctaccagctcgccattctgaaggggatgaaagcaaacgtccaggcaaaccatcaaatgacaccggattcgatcggtctattgatgagctattttatcggcaagtttacagaagataccagtgcgttttcaattttggaccctgcggtgggcaccggcaatttgcttgcgaccattttgaaccagctcagtgggaaaaacatcaccgcttacggcgtggatatcgatgatgtgctgatccggctcgcatacacgggggcaaaccttctgcaccatgaaatcgaactgtttacgcaggatgccctgtcccaattgttcattgaccctgtcgatgttgttgtttgcgatttgccagtcgggtactatccgaatgatgcgggcgccgcggattacaagctgaaggcagatgaagggcattcgtacgcccatcatttgtttatcgagcagagcctgagagcggcgcgcccgggcggatttttgttttttctcatcccaaacggattatttgaaacaaaagaagctccgaaacttcgccagtttttaaaagaagaagcggatatccaggcgattttgcaattgccgatgaccatcttcaaaaacgagcaggctgccaaaagcatttttgtcatccgcaagaaagcggaagacgtaaaagcaccggaacaagtgctgctggcgtcgctcccgtccctgtctaacgaaaggtcgctcaggcagctgatggcaaagattgacgtctggtgcaaagaaaatatccaaagcggcaaaatttgacgaattgggaaaaatgggggccggaaagcaggaaattgcgttccggcccccatttgtttgcttttttatggtatcattttatatgttcccgggagacggaaccaaaaaccggttgaaaaaaaccggatagaatggcaaaatgagaaaatgagatcactattttaaaaaaataaaagggttcatttgattttgcgaagggaagacgagcaatggcaaaaattatggcaattaatgcggggagctcctccttaaaatttcaattatttgagatgccgaatgaaagcgttataacgaaaggcctgattgaacggatcgggttaaacgatgccttgttttccattacggtaaacggggacagggtgaaggaaattaccgatattccgaaccatgaaattgccgtgcagtttttattaaaaaaattaacggaaaccggcattatccggtctttggatgaaatagaaggcgtgggccaccgggttgtgcacggcggcgaaattttcaatgattctgctgtcgtcaatgaccaggtgctcgcgcaaattgaagatttggcggaactcgcgccgcttcataaccgggcgaacgcaacggggatccgggcgttccgtgccgtgctgccggatgtggttcaagtggccgtgtttgataccgctttccaccaaacgatgccggaaagtgctttcttatacagcctcccctatgcatactacgaaaaataccggatccgcaaatacgggtttcatggcacttcccataaatatgtggcgatgcgtgccgctgagctgctcggcaggccaattgaacagctgcgcctgatttcatgccatttgggcaacggggcaagcattgcggcgatccagggcggccggtcaatcgatacgtccatgggctttacgccattggccggcgtgacgatgggcacgcgctccggcaatatcgaccccgcactgatcccgtttattatggagaagacaggcaaaacggcagaagaagtgctcgaagtgttaaacaaagaatccgggcttctcggcatttcgggcgtttccagcgatttgcgcgatatccaggtggcggcggaactcgagcggaacaagcgggctgaactggcgcttgacatttttgcaagccgcatccataaatacatcgggtcgtatgcggcgaaaatggccggcgtcgatgcgattattttcacggctggcatcggggaaaacagcgatgccatccgcgcaagaattttaacgggactggaatttatgggcatttactgggacccgactttgaaccagatccgcgggacggaagcgtttatcaattatccgcattcccctgtaaaagtactcgttatcccgacaaacgaagagctgatgatcgcacgcgatgttgtccggctctcttcatgaccgcggaatcttaacggctggcgccgacagtttgctttcctgctgcccgtgcccgaataaattgtttcagggtcactttggcatggcataaacgaacagccgtccatgaactttatgatataatggctgtaaaacagcgttagggagcggattgaaaatggcggaatggacaggcagggaaaaaattgtactggatgaaatcaacgactgggcggagaagctaaaaacggccggaaaagaaggggacgggcgcaagcaaaaactggatgcgctctttgcccattttccggatgaggcgctcgaaaatattcatgaaaaaatagatgctgttttgtttcaaatctgttcatttgccgatgaaaatctgccttacgggcatgaaatcgaaaaaatacttgctgcggggcggctttttgacagttctgttgcaacgattcccgatatgaggaagcttaccatcgaccaggcagggtttattgcggcgcggcagcaggcaaaataccgccgtttctcactcttcgaaggagcattgagcgggacggggaaagctgtttttgccgcggcggatccgtttttcctgctggctgtgaatctccgggcggtccagctcaccggtgcagcttacggatttgaaacaaaaacgcccggcgaactcgtggcggcgctgaaaatggtgctgatggccgctgccccggacatggtgaaatatgcgctctgggaagaattgatggatgaactggaagcgcgcgagaccggcttctatgtgggaaacgataagttattccaccggtatttgtggccgggggcaatcgggcatgccggcaaactcgcttttctggcgctgctccggccgaaaaagcggggagaaaacagctgggccgggatggccatcggggctcttacaaactactatttttctaaaagggtttgtgaaattgcggagaaatattatcaataccggtttttaacagaaaaaagcggccgttaaaaaaccagcccgtaaaaggctggtttttgcttaattttcccctttgccttcttcttccttaggcgttctcacgacaagcacatcgcagggggaagtgcggacaatatgttcggaaacgcttccgatcaggagcctttccaccgcgtttaaaccggttgcgccgcacacaattaaatccgcatgcactttcggcgcgacattttttgtgatttgaagttttggagagccgagctggatgatcgtctggactttgatccctttttctgcggcgcggtctttataattgcttaacagttcatccccaaatttttcgttttgctcatagagcgttgaatcaatcggggtcaaagtggcgagtgctcggttatcgaccacatggacaaccgataattcggccccattccgtttggcgatttcaaccgctttcgtaaaagcccagtcggcttctttggagccatctaccgctactaaaatattccggtattgtgtgcccatcttctttcatctcctttataaactgcctgcctttcatgtctattttactagaattttccgggtttgtgtgcgaaaaatgaaaaaacctggcgatctattttttaatcaaaaagggcggaagccaggaaaaataaaaacgctatcccgttcccgggcgcgaataagaaatttgcaaaaaaagcataggaaaaagagggaatttttgctacactaaagatgtttaagaaagttttcaaccgtttgatatgttttcttacaataataagaaaacggattgcaaaacacgaacaagaggaggaactttctatgcgaattggcgtaccaaaagaaattaaaaacaatgaaagccgtgtggccatgaccccggccggcgttgtgaccctgaccaaagcggggcatgaagtttttattgaaaagaatgcgggccttgcatcggggtttagtgatgaagaatatgtaaaagccggtgcccggatcgttgagaccgctcgtgaggcgtggtcttttgaaatggttatgaaagtgaaggagccgatcgaaagcgagtaccgctatttccgtgaaggcatgattttatttacatatttgcatcttgctgcagcaccaaagcttacggaagaactgctgaaaaagaaagtgaccggcattgcttatgaaaccgtgcagcttgccaaccgttcgctgccgcttctgacgccgatgagcgaggtggcgggcagaatggcgccgcagattggcgcacagtttcttgaaaaaaataacggtggaaaagggatcctgctttccggcgtaccgggcgtcaaaagaggcaagattacgattatcggcggcggggttgccggaacgaatgcggcaaaagtcgcgatcggccttggggcggatgtgaccgttgtcgaattgaatccggatcgcttgcgccagcttgatgacattttcggcagcaaaattacaaccttgatgtcgaatccatacaatattgcggaagcagtgcgtgatgcggaccttgtcatcggatccgttctgatcccgggtgcaaaagcgccaaaactggtaacggaagagatgatcaaagcgatgcagccgggctctgttgtcgtggatattgcgattgaccagggtggcagttttgaaacgacagaccgtgccacgacacatgatgatccggtttatatcaagcatgatgtcgtccattatgcagtcgcaaatattccgggcgcggttgcccgcacatcgacgattgcccttaccaatgtgacggtgccgtacgcggtgcaaattgccaataaggggtatgagaaagcggttttggaaaatgaagcgctgttaaaaggggtcaatacgctgaacgggcatgtgacgtatcaagcggtggccgattcgatcgggctctcctataccgatgtgaaaacgcttttaaaataagctttcaaaagccggctgcaagaattgccggaacaaaaaaagaagcacaagcagcatgaaagccgcttgtgcttcttttttaaacatactgcaaggctttcgggtactttgtcagcacttcggcacccgtttttgtaatgcagacgtcatcttcaatccggacgccggcaacccctggcacgtatatccccggttcgatcgtgaagaccatcccttcttcaagcaccagctcattcgtatgggtgacagaaggatattcgtggatgctgatcccgaggccgtggccgagccggtgtgtaaaatattcgccgtatcccgcgtcttcaatgatgcggcgtgcaatcaagtcgagctcttttgcctttacccccggttttgctgccgcaacggccgcttcttccgcttttaataccgtttcgtaaatccgggtttgctcttcgttaagccccccgaatgcgaccgtccttgtaatatcggaacagtagccttgatgcacaacgccaaggtcaaacaggacaaaattccctttttcgatcttgtcaaggccggggacgccgtgcggggaagccgccttcgcacctgagaggacggtggtggcgaagctcatttctgaaatccctttttctttcattgcaaattcaatggctgccacgatttcaagttcggttttcccttccttaatttcgcggatgcccgtttcaacggccaggtcggcaaaagcagccgcttcccttaaaatcttccgttcatgctcatctttaataaggcgcatcatgcgcagtttttcttcagcagcggtaaagcgggcgccgccaaaccgttctttcagcgcttcgaaccgttccacgttcaaatgctctttttcaatcgctaacgtatggacatccccgattcgcccgcgtatttcttccgcaaccaaatcccacgggttatccgtatcctggacgccgagaatgtcatattcccagccagcttttttcgcgtcatatgcctccattgccgggcagacgagaaacggctctttttcttggaatacacaaatgccgagcagcctttcgtgcgggtcgctgcggtaaccgctcaaataaaagacattgtcgggcgatgtaataaaagcagcatcggtcttttccgctttcagccacgccgccacacttgctaaacgcttattcattccattcatctccttatcagacgttactagcatagcaaaaaacaagttaagatgctacaggtgaagcgcgaggcaggattacggggcaaagaaataatataatgaaagtggcccctaaaagccgtacaaatttttaaaaggagtgatatgttgatgaaagtttcttttcacggccattcgattgtaaaagtggaaacggagggcaaaacgatactctttgatccatttattaccggcaacagccagacagacctgaaagtggaggaagaaagcccggatgtgattattctcacacatgggcacggcgatcatatcggggatacagaaacgcttgcccgcaaaaagaatgcgcttattattgccaataatgaaatcgcaaattactttgcctggaaagggttgaatacgcatccgctccatatcggtggctcgtaccagtttgatttcgggaaagtgaagcttacccaggcgttccacggctcggcggttgtggatgacgaaaagaaagaaatcgtttatctcgggatgccgacgggcgttttgctgatggcggaagggaaaacgatctaccacgccggtgataccgggctgttctcggatatgaaattaatcggcgaacgccatccgattgatcttgcatttcttccgatcggcgacaacttcacgatgggaccggaagacgcagcagtggcggcaacatttttgcaggcgaaaacggtcgtgccgatccattacaatacgttcccgctcattcagcaggatccgcagaaatttatcgatttgctcgacggcgtaaacggtaaaattatgaaagccggagatgcgatcgaattgtaatagacgcgcaagattggcaaatacaggggttcgcttgcagccggcatgtgctgaaaaagtgccggccgcacttccccttttccatgatggaaagataaaggtgcctgattgccctttccccctttttccatctataatagaattatacagatgactccatacatattccttgaaagcggataaaaacggaaagaaggtgaaaaaatggcgacaaagcacgaacagattttacaatatatcaatgagctgccagtcggggaaaaaatatccgtccgccagattgcaaaagcgctgaatgtcagtgaagggactgcctaccgcgccattaaagatgctgaaataaaagggtatgtcagcacgattgaacgggtcggcaccatccggattgagcagaagaaaaaagagaacattgaaaagctgaccttttcggaagtcgtcaatattatcgacggccaggtgctgggcggaaaatccggcctgcataaaacgcttacaaaattcgtgatcggcgccatggaacttgaggcgatgtcgaagtatacggatccggggagcctgctcattgtcggaaaccgcacggacgcgcatgaactggcgttaaggtcaggagctgccgttttgatcaccggcggatttgatacgaaagattatgtaaaaaaaattgcggatgaaaaagcgctgccgatcatctcgacgagctacgacacgtttaccgttgcgacgatgattaaccgtgctgtctatgaccagctgatcaaaaaagaaattattctcgttgaagatattttaacaccgatcgaaaaaacggtttatttgaatacaacggacatggtccaggactggtaccgcaaaaaacgggaaacaggccactcgcgctttcctgttgtcgaccgcaatttaaaggtggcgggtattattacctcaaaagacgtgatggaaaccgacacgcacttaagcatcgagaaagtgatgacgaaaaatccgattacggtcagcgaaaaaacaagcgttacatctgttgcccatatgatggtctgggaagggatcgaaatcttgccggtgaccgacgattttaaccggctgagggggattgtcagccgccaggacgtcttaaaggagctgcaaatgacacagcgccagccgcaagtcggggaaacgatcgacaatatcgtcacgacccagcttgatgcatcatcggccaaaacggaagacccggatgattaccagtttgaagtgacgccgcaaatgaccaaccctttagggacgatttcatatggtgtattcacgacactcgtgcacgaaacgaccaaccgctttttgcgctccagaaaaaaaggcgaaatgatcatcgaaagtttaacggtctattttatcaaaccagtccagctcgaaagtatgatccggattgtaccgaaaattctcgattccggccggaagtttgccaaaattgatgtcgaagtcttcaaccagggcagccttgtcggtaaagccctgctgatgtgccagctgattgaaagataagggaatgtgccacccctttttacggtgtacgccgcaattcgttcctttctttttgcatttcgggccggtaaaaccgcagccttttgaaaccgcctgcgatattgaaaagcccgagcgcgataaaaatggctgcaatcacaaaggtgatggcagtgtgaaacagaaacaattcattcacgccgaacaaaaaaataaacgaaccgagcgccatattggctttggcagagaacacctttttttccatcgccaaaaggctgcggatgtattttagtttaaaatatacatacgcgcaaagggatgcgagaatcaaaacggcaaggatcggcatcgtgcacctccaaatcgggttgtcagtattttcttctattttacaaaatgaaaaaagaacttgccagagaaacggggagtaagatgaaaacaaaaattttacagacgatcaagctttttgacacgatcatcatccaccgccatgtccggcctgatccggatgcatatggatcgcaggggggacttgcggaaatattgaaggcgtcttttccggataaaaacatttacatcgtgggcgatgatgaaccggacctcgcctacttgaataggatggacaggatttccgatgaaacgtaccgcggggcgcttgtcatcgtttgtgataccgcgaaccgcgagcggatcagcgaccagcgtttccatctgggggaaaggctgatcaaaatcgaccatcacccgaaccatgatgcttacggggatttgcagtgggtcgatgaagacgcgtcctctgtcagcgaaatgatttatgagttttacttatcggggaaagaagaagggctcaggatgacagatgccgcggcaaggctgctgtttgccggcattgtcggggatacaggccggtttttgtatccgagtgcgacggaaaaaacatttgactatgccggagaactgatccattaccattttgaccggacagcgctctttaacaagatgtacgagattgaaccaagtgtggccaggctgcaagggtatatataccagaacctggacattcttgagcacggggcggccatcgtcgtgctgaaaaaagaactgattgaaaaattcggcgtaacggtgcgcgaagcctcccagcttgtcaccacgctcggcgatattaaagggcttaaagcctggtgcttctttatcgaagaagaaggccaaatccgcctccgtttccgctccaaaggccctgccatcaatgagctggcccgcaaatacggcggcggcgggcatccgcttgctgccggggccaacgcgtattcgtgggaaacggcagaggcggtaaaaaaggaattaatcgcgctctgcaaggaagggtaaaaaaagaaggcagaaccgccggaaaagcggatttgccttcttttagtctgccagctttaaattcaggtggacgcggacaacagagtaaaacaaaatgtcccgcacttcgaaagtatagcggcggtggttgattttaatgactttgttttcaagcatgcgggtgatcaagtctttgttcaaataagcggtttttaaattttttgcaatcaaggggcttaagtcatgtttaatatcctcttctgcttcaaaaatgctttgtgaatcgtgaatgtcatatttttcgtagttgctgattttcacgtcaatacgctggatggtcaggagcttttcatttttttgattgagctttttatagtcttcctgccagatcgccttttcctgttgcaaatcctggatcgttttttcctgccgttcaatcatttgcgcctgcctttcctgcatgacaccgaacatgtacagaaaaatcagccagcagatgcacccgcccacgataaatccggccatgaaccgctgccagcccggtttccggtaaagcggcgggattctcatagcacattctcctgggttatccatgaaataatgagcgcggccgttttggcaccgcccatggccgacagaattaaaagcagctgcttgaacaataccatcgtctcgctttccaaaaatcctttttcaaagctgtaaacggtatcgaacgtccccccgatggcggcaatgatcgcccagatgcggaggtcacgcgcaatcttcgaaatttccgtcaaaagcggctcgccggtaatgaacgaagcgagtcccccgatcaaggcgccgccgaacattacgccgaatgcgataaaatagctgttgaaaaatgcgggaaaaaatccttcgctcaaccgaaccatccccatcttttcttcattactaaacaatatatgggacaatgtatgcctgtatgaaatcgaacgtatcttcttttttgctcgcgtgaaaacatgtataataagaatcatgtacaggtacgaataggaggcagtttaccatgcgttttgtccatttacaggtccaaacggcctacagcctgttggaaagtacgatctccatccctgaatgggcggcgtacgcaaaagcgcttcattacgacacccttgcgatcacggaccgcaatgtgatgtacggggcctttcctttttacaaggcttgccgcgaaaatggcattaaacccattatcggcatgacagcggatatcatgagttcgtttgaacctgacacagcctatccggttgtgttgcttgccaaaaacgaaaccggctaccggcatttgatgaaaatctcaagtgccatccagacgagacccgaacccggcatttttatcaaatggctgcgcgcctacagcgacggcctgatcgcctttacgccggggcttgaaggggaaatcgaacaggcgctacttaggggagatgaagcgcgtgcagaagaggttgcagttttataccgggacattttcgggccgagcttttatcttgcacttgaaaacaacgggacagtgcaagctaagaaagtgcttcccgatatgcacgcgctctcggaaaaactgggtatcccagaagtggcggccgcaaatgtgaaatacttaaaaaaggaagatgctttttctcatgaagtgttgcgcgcgatcaaagccggggtgaaactgacggatgaaaaccggccgcgcccggaaagcggcacgcacgactttaagccgcaagaggaaatggaacagctttttgccgatttcccggaagctttggccaatacggaaaaaattgcagatgcctgctctgtggaaatcaaaacgggacagcggctgctgccggcatttccggttccgggcgggcagacggcggatgccttcttagaagaagtatgccgaaaaggccttgcagcacgcgttccgaatctggaagaacggtatacagaccggctggagtatgaattaaaaatcattcaggaaatgcagttcagcgactatttccttattgtctgggattttatgaaatatgcgagggagcacgggattcttaccgggccggggcgcggttccgctgccggctcccttgtcgcatacgcgctttatattaccgacgtcgatccggtgcaatacgggcttttgtttgaacggtttttaaatccggagcgcatttccatgccggatattgacagcgattttccggatcacaagcgggacgagatgattcgctacgttgcggaaaaatacggcagacagcatgtcgcgcagatcatcacattcggcacatttgctgcgaaagccgcagcccgggatgtagcccggatattcggtctcagcgcaaaagaacttgaacagttgtcgcgcttcatcccgtcacagcctggcatgacgcttaaaaaagcgtatgaagcatcaagcgcctttcgggaatggatcggccaatcggatcagcaccgcaagctttttgaaacggccctgcttttggaaggattgccgcgccatgtttcgacccatgcagccggcgtcattatcagtggggaaccgcttacgggaatcatcccggtgcaggaagggcatgacggcatctttttaacccagtatccgatgaaccatctcgaagaaatcgggcttttgaaaatggattttctcggcttgcggaatttaaccatccttgagcatatcctcacggggattgaaaaggggacggggagaaaaatccgcctccaggatgtaccgctcgatgatccacagacattccgcctttttagttcgggcaatacgaccgggatcttccagttcgagtcggacggcatgcggaaagtgctcgagcggcttaaaccgactgaatttgaagacattgtcgcggtcaatgcgctgtaccggcccgggccgatggaaaacatcccggcctatattgagcggaaacacgggttgaaaccggtcgaatatccgcatcccgacctccagccgattttggaaaaaacatacggtgtgattgtctaccaggaacaaattatgcagatcgcttcaaagatggcgggcttttcactcggggaggcggatttgctccgccgtgccgtcagcaaaaagaaaagggaaatcctggacgaacagcggctgcattttataaatggcgcgcaaaaaaaaggatatgagagaaaaacggcgaatactatttatgattttatcgtccgcttcgccaattatggttttaaccgcagccatgccgtcgcttacagcatgctcgcttgccggctcgcctatttaaaagcccattacccgctctattttatggcaagccttttgacgagcgtgatcggcaacgaggataaaattgcccagtatattcgcgaagcgcagcagatggggatccgggttttgccgccttccgtgcagcacagccattatccgtttaccgtggaaaacggcgccatccgttatagccttgccgcgataaaagggatcggatacgcctccatcaaagagctgcttaaagaaagaaaacggcgcccgtttaaaagcctgtttgatcttgtcctgagggtgaaagggctgaaccggaaaattttagaggcgtttgcattctcaggcgcgatggatgagtttggaaaagacagggcagttttgcttgccagcattgatgtcgcccttgagcacgcggagattatgaagccggatgacgggcaggcggatctgttctttgaggatgaagcgttcagcattgaaccaaattatgtggaaaccgagccgatttcactgatggataagcttgcctttgaaaagcaatatttggggctctatctatccgggcatccggccgggcagtaccgcccgggttgggacgaagccggcgtgcttgcagtaagcaagcttcaacccggcatgagaaaaatccggtttggcgcctgcattacggacacaagaacgatccgcacaaaacaaggcagcctgatggcatttttgcgcatgagtgacgaaacggatgagatagaatgtgttgtttttccggatgtctttaaaaaatacagcccgttatgccaaaaagggttgattgtggtcgtggaaggaaatgttgaaaacaggaacggcaaaaagcaggtgattgcccgggcgctcgaagatgccagcccgttccgcagcatgccgaccggtgccacgttatatttaaagattccggctggaaaggaccgcatgctgcttgttcaagtgaagcaggtgcttgacgcttttccgggggactcgccggtcattcttcattatgaagcggaacggaaaacgatccggcttccggaaaaaaaccgggtccgggcggaggaagcatgcctcggaaagcttacggaactgcttggtgaaggaaatgtcatattgaaataagtttttctctctagattaaatatgttatattgtttaataggcttgtgagtaagaaaccgcatatcgtgcagtgaaaacgggggagtgaggttcatgtcattgcgggaagaagcgttacatatgcaccgcgaacacaaagggaaattggaatccaagtcaaaagtcaccgtcaaaaatgcaaaggatctgagcctggcctattcgcccggtgtggctgagccttgcaaaatgatctacgacaaaccggaaacggtctatgaatatacgatgaaaggcaatatggtcgcggtcgtaacggacggcaccgccgttctcgggcttggaaatatcggccctgaagccgcactcccggtcatggaaggcaaggcgattttgttcaaaagctttgccggcgtcgatgcctttcccatttgcctcgatacgacagatattgatgaaatcgtggagacggtgaaacggctggaaccggttttcggcggcgtgaatctggaggacatcgccgcgccgaactgctttgtcattgaagaaaaattgaagaaggaaatgaatattcctgtttttcacgatgaccagcacgggacggcgattgtaacggctgccgggctcgtgaacgctttaaaactcgttggcaaagaaatgtctgaaattaaagtggtagcaagcggcgcgggcgctgccggcatcgcgattatcaaactgctttacaactttggcgtccgcgatattattatgtgcgactctaaaggggcggtctatgaagggcgcccgttcggaatgaacaaggtgaaatccgaagtggctaaatatacaaaccgtgataaagcagcaggcagcctggcggatgtaatcaaagatgcggatgtttttatcggcgtttctgtagagggggcactgacaaaagaaatggtgcagtcgatgaaaaaagacccgattatttttgcgatggccaatccgaatccggaaatcatgccgcaagatgccaaagcggccggcgcgaaagtcatcggcacaggccgctctgattttccaaaccaggtcaacaatgtcctcgccttcccgggtattttcaggggggcattggatgtgcgcgccacgcatattaatgaaaagatgaaacaagccgctgtccacgcgatcgccggtttaattgatgaacatgaactgaatgcggattatgtcattccgcgcccgtttgatccgcgtgttgcgccggcggttgcggcagctgttgcaaaagcggcgatggaaaccggtgtcgcccgcatccaggtgagcccggaagaaatccgcgaaaaaacgaaacagctttccgaaattggcaaataagcatcagatgccggaaaaaaagccgcctttttgccggtacgggaaaacgccatttgccggtacttcggcagaaaaaccgccggcttgcccggtggttccggtgccagatacaggaggggtaagatttgctgaaagattttttttctaaaccgaaaaagcgaaaatatgcgactatcccttcagaccatacaaagcaggaagttcctgaagggatcatgtcaaaatgcccgaagtgcggcaaaattatgtatacaaaagaactgcagaagaatttaaaagtctgcctccattgcggctaccattatcaaatgaccgcttatgaaagggtggaaagcctgctggatgaaggaacgtttgaagagttcgaccgcgggcttgtttccaaaaacccgcttgcgtttccgggttaccttgaaaaactggaaaaagaccgcaaaaaaacaaacttgaatgaagcggtactgacaggtaagggcaacattcaggaaaggccggtcgtgcttagtgtcatggatgcacaattccggatgggcagcatgggctcggttgtcggcgaaaaaattacgcgcgccatcgaagaagcagacaggctccatgtgccgtttatcattttcacggcctcagggggcgcccgcatgcaggaagggatctattctttaatgcagatggcgaaaacgagcgcggcgctcgaaaggttcagccgccacggcgggttaacggtaaccgtgatgactcatccgacaacaggcggcgtgaccgcaagctttgcatcgctcggggatatcaatcttgcggagcccggcgcgttgatcggttttgccggccgccgcatcattgaacagacgatccgcgaagaacttcctgaagttttccagactgcagaatttcttcttgaacacggccagctcgatgcggttgtgaaacgccatgacctgaaaaaaacattggcaggcattctggacatccatcaaccaacaaacgcaggtgaactacaatggtgaatgaacttgaatttgaaaaaccggtcattgagctgaaacgcaaaattgccgagctaaaggaatttacaaaacagtcggatgtcgatttgtcaagcgagattgaaaaactggaagcaaggctttcccggctggaagaggaaatttacgaaaatatggatccgtgggacagaatccagattgcgcgttttcccgaacggccgacatcattggactatattcaatatctttttaccgattttcttgagctccacggcgaccgtgtatacggcgacgacggggcggttgtcggcgggatcgcaaaatttgagggccttcctgtcaccgtgatcggccagcagcgggggaaagacacaaaagaaaacatccgccgcaatttcggcatgccacacccggaaggctaccggaaagcaatgcggctaatgaagcaggcggaaaaatttaaacgcccgattatcagcttcatcgacacaaaaggtgcgtatccgggaaaagcagcggaagaaaggggcatcgctgaatcgatcgcgcgcaatctgtttgaaatgtccgggttgagcgttccgatcatctgcctgattatcggtgaaggggccagcggcggtgcgctcggcattggcgtcggcgaccatatccatgtcctcgaaaattcatggttctcggtcatttcaccggaatccgccgcggcgcttttatggaaagatgcgtcgcaggcaaaacgggccgtcgccaccatgaagatgaccgcgcccgagctgaaagaactgggtattatcgatgaactgattccggaagtaaaaggcggcgcacataaagatccgagagcgcaggcagagctgatgcgccctgtgcttgccgcatcattaaaggagctgcgggcatatgcccctgaagaactggtggaaaaaaggtacgaaaaataccgtaaaattggcgtattttcaacgctcgaacagtttgcccgccaatagccgaaaaaagcacccaggcaaccggcacccatcaccggttgcctcgctttttacatggtgtaacggatgcaggccaaaattttggcgttctgctttctaactatataaaatgaacttaagtttttcgtaccaaaatcaatgacgatcaggatggcagcacataaacaagtagtaatgtttagttcaagttatataggatcccctttcttctaagtggttgaaaagaaaattcagatcctggtttaccggcatggaaaccgggaaaagaaaaaagaacgccgtttgcatggcaggcagggaagacaggagaattggtaacgtattcatactattccgacacagtttgttcataaacgcacatttttaaaatttttactttttcatgatcgattgtgaacatgcttttaaagtggtattttagatatattcgaaggcagacttggagatactataattactttgcttgattgaaataccggcctgccaagagaattacatatacagaggtgaataatatgaagcgaattggagtattaacaagcggcggcgatgcaccagggatgaatgccgcagtccgcgcgattacccgtaaagggatttatcacggcctggaagtttacggtattcaccagggctataacgggttgattcatggtaacgtccaaaagcttgaagcaggatctgtcggtgatattctccaacgcggcggcacggttttgcagtcggcaagaagcgaagaattcaaaacgccggaagggcagcaaaaagcgatccggcagctgaaagaccatggcattgaagccctcgttgtgatcggcggggacggttcctatcagggagcgaaaaaactgacagaacaaggtttcaactgcatcggtgtgccggggacaatcgacaacgacatcccaggtacggattttacaattggttttgatacagcgctgaacactgttctggatgcgattgacaaaattcgcgacaccgcttcttcccacgaacgtacctttattattgaagtcatgggcagaaatgcgggggatatcgcgctttggtccggtcttgccggcggggctgaatcaattattgtgccggaagaaaagtttgatttgaaagatgtcgtggatcgccttgaacaagggaaaaaacgtggcaaacgccacagcattatcatcgtcgcggaaggcgtgatgagtggtaacgagtttgcggaaaaattgaaaaaaactggtgcgatcggtgatacccgcgtttccgttctcggccatatccagcgtggcggttctccgactgcatttgaccgcgtgcttgcaagccgcctcggcgcaagggctgttgaactgctgctcgaaggaaaagggggccgcgctgtcggtattcaaaataaccagctggttgaccatgacatccttgagattctcgggaaaccgcacgccattaatcaaaacatgtataagctgtcgaaagaattgtcgatctaacgttgtttaggaggaaatagaatgaaaaaaaccaaaattgtatgtactatcgggcctgccagtgaaagtgtggaaatgcttgaaagattaatggcaaacgggatggatgtttgccgcctgaacttctcgcacggcagccacgaggaacatcttgcccggattaaaaatatccgcgaagctgcaaaaaaccaaaacaaaacgatcgggcttttgcttgatacaaagggaccggaaatccgcacccacgatatgaaagacggcggatttgagcttgttgaaggcatgacgccggtcatttcaatgacagaagtgctcgggacaacggaaaaattttcggtcacctatgaagggctgattgatgatgtgcacgttggctctaaaattctgcttgacgacggtttgattgaactagaagtgacggccatcgataaaaacgccggtgaaatccatacaaaagtactgaaccgcggcgttttgaaaaacaaaaaaggtgtcaacgtcccgggtgtttccgtgaaccttccgggcattaccgaaaaagacgtgagcgatatcctgttcgggcttgaacaaggcattgacttcattgcggcttcatttgtacgccggccgtctgacgttttggaaattcgccagcttcttgaagaacacgatgctttacatgtgaaaattttccctaaaattgaaaaccaggaaggcgtcgacaacatcgatgaaatccttgctgtatcggacggcttaatggttgcccgcggtgatctcggtgttgaaattccgaccgaagcagtgccgctcgtgcaaaaagaactgatcagaaagtgcaacacgctcggcaaaccggtcattaccgcaacgcaaatgctggattcgatgcagcgcaacccgcgcccgacccgcgcagaagcaagcgacgtggccaacgccattttcgacggtacagatgcaatcatgctttccggcgaaacagcagccggaaaatatcctgctgaagcggttaagacgatgtacaatatcgcggtccatgtggaaaaagcgattaaccaccgcgatattctgaacaaacgcagcaagagcacggaccataatatgacagacgccatttgccagtccgttgcccatacggctttaaatcttgatgtgaatgccattattgcgccaaccgaaagcggctatacggcgcgcatgatctccaaataccgcccggcagccccgattattgctgtcacgagcgatccgaaagtgcagcgcggcttaaccgttgtgtccggcgtatacccgcaattgggcacaaaggcaaacaatacggatgaaatgcttgaaatcgcagtggatgaagcattgaaatccgatatcgtccatcacggcgaccttgtgattatcacagccggcgtccctgttggtgggaaaggcacaaccaacctgatgaaagtgcacctgatcggcgatatattggcaaaaggccagggaatcggcagaaaatcggcatttggtccggtcgttgttgctgaaagcccagaagaagcaaacgcaaaagcaacagaaggctgtgtgctcatcacgagaacgaccgacaaagaaatcatgccggccattgaaaaatgtgccgcgctcattacggaagaaggcggcttgacaagccatgctgcagttgttggcatcaatgtcggcattccggtcattgtcggcgttgaaaaagccgtttccatttttaaagacgggcaggaagttacggtagatgcagcaaccggctcggtttacaacggccatgcgactgtattgtaaataagcaaaaaaaacgcagaggcatccggcctctgcgttttttatattgtttttttgcccataatatagttccaaatgtcatggaatacatgggcgcggatcagcgcggtcagcaacacgagtgtaatcggcccgagaatcaagccaaggaacccgactgttttaaagccaataaacagggcgataagcgtcgcgagtggattcattccgatgctggacgataaaattttcggctccataatctgcctttgcacgatcacgacaatgtaaaggacggtaagcccgatcgcaagcggcaggctgccggtaatgaattcgtaaatgatccaggggacaaacacaacgcccgttcccaaatacggcaaaatatcgacaatgccgcaaacaagggcgattgtaatcgcgtaatccacgcgtaaaatcaaaagcccgatcagcacaatgacaagtgtcatggaaatcagtgtcaattcagcacggacaaaaccgaaaagcgcattgcggaggtcggcaaacacggtgatcccgctttttcttgcttttttcggcagtaacagctttcctttgcctgtcaactggttccagtccttgctgatgaaaaacgttgcaagcagggcaaaaatcagcacggttgccgcatttggaatccaggaaacaagccccggcagttttttaaacagcccggacaggaaatcacctgctgaagaagcgatcttttgcccggccgcctgaatgttttgcacgatcgtttcctgctggcctgcatcgagatttttaaagaggcccgccagctggtcgtacagcggtaaaacttgggcggtgacaagcgattccgaataattgacaagcgtctggacatgctccggcaaaacgtcagcaaggtaattcgcccccgttacgatctcggcaacaagcagcgtaatgatgccgacaaagacgccaatgatcagaatcagggatatcaaaacagcaagcgcccgcggaagccttacctttctgtccagaaaattgacgagcgggttgatcataagcgcgatcaacagcgcaataataaacggataagcgtattttacagccagataaaccgcaaaaaagccaaccaggatgcacagtgcaacaaaaaggccccgcagcgcgcggtgtatgtaaacagaattcaagtctgaccctcctgtattcgttaatatgttattattttacacggcggggggcgtaaaacaaagaaaaagccgttttttttgatagattttctatttctatcttcgccaaaaattcagaaaaaatacccggcaccaaaagattttcagcatgaaagaagggatgcttatgtaccagccgtatttatttttgctgctgcttttagcgatcggatttgcggcaaaaaaccaatcgttaatcatttctgttatcgtgctacttgtcctgaaagtggcagggctggatgcgaaaattttttcaaccctccagtcgaaagggatcaactggggcgtcaccattattacgatcgccgtccttgtgccgattgcaaccggacagatcggctttaaagatttgtatgaatcgctcaaatcgccgtatgcatggattgcacttgcatccggtatcattgtcgcacttctggccaaaaacggcatcaccctgcttgcgagcgacccgcaaattacgacggcgctcgtgcttggcaccattctcgccgtttctttgtttaaaggggttgcggtcgggccgctgatcggcgccggcattgcctggatggccatgaaaatcgtcgaatgggtgacaaacagtttttagccgggtggaatttgcttaaacatgtaaaaaccgttgaaagaaagatttttcaacggtttttctcctgctgctacagaagggcatatgctaaaatcaaaatgattgccagcacggctgcgaaagcgctatactaaaagaagaaatttggcttttttctgtaccaatgtgtttgaaaattgtttataatgatttatgtaagcgggcgcatgtacgtcaaaaaatagacaaatataattattatattataatagagtatgtgatcgcttgcatattgccggccggcaaccgttatttattccgcagaaaaatatataccccgaaatcaacttatctacgtttgagatgggggaaacaaccttaaggagaaggagagataagcatgacagcaacaagaggtctagagggggtcgttgcaagtgaaacttcaatcagctcgatcatcgatgacacgcttacatatgtcggctacggcattgatgatttagcagaaaaagccagctttgaagaagtcgtctacctgctgtggcatttaaaactgccgacaaaatccgagctggaaacatttaagcaggaactggcggatcatatggaattgccgaaagaaattttggatagctttaaaacttacccgatcgggaaagtgcacccgatggccgcgctccgtaccgctgtttccgcactcgcgctttacgatgatgaagcagatgcaatggaccgggaagcaaacttgcgcaaagccatccggctgcaggcaaaaataccggcaattgttgccgctttcgcaagggtcaggaaaggcctagaacctgtcgcaccgcgcagagatctcggttttgccgcaaacttcctgtacatgttaaaagaaaaggaaccggaaccgattgaagtggaagcctttaacaaagcgcttgtactgcatgcggaccatgaactgaacgcatccacttttactgcacgcgtttgtgttgcgacgctttccgacatctattccggcgttaccgctgcaatcggcgcattaaaaggcccgctccacggcggcgcaaatgagcaggtcatgaaaatgctcacggaaatcggttcggtcgataaagtggaagattacctgcatgaaaaattcatcaacaaagaaaaaattatgggttttggccaccgcgtttacagaaaaggcgatccgcgcgcaaaacacctgaaaaaaatgtcggaaaaattgacagagctgaccgggcagcgtaaatattatgatatgtcggtaaaaattgagcaaattgtcacgagcgaaaaaggcattcctgccaatgtagacttttattctgcatctgtctatcattgcctcggcattgaccatgacctgtttacgccgatttttgccgtcagccgcatttccggatggatcgcccatattttggaacaatacgccaacaaccggattatccgcccacgcgcggaatatattggcccgggcatgcgccagtacgttccgcttgaagaccggtaacgggacctggacggggaaccatcccggctgaatgtatccgttattttcttaaaacgcctgcccgttcctggaagacttttgaggatgggtaagcgtgcatctggtggggaaggaccggctcaggaccatgcgcggggccggttcattccgtgtacaccacaagtataaactgatattgggactggaggagattttgaaatggcacaaggagaaaagatcaccgtagaaaacggcgtattaaacacaccgaatcacccgattattccatttatcgaaggggacggcaccggccctgatatttgggcggctgcacagcgcgtattggatgcggctgttgagaaggcctataaaggcgaaaagaaaattgtctggaaagaggtctatgcaggggaaaaagcgttcaataaaacaggggaatggctgccgcaggaaacgcttgacacgatccgcgaatatttcattgccattaaagggccattaaccactccggtcggcggcgggatccgttcgctgaatgttgcgctgcgccaggaactcgacttattcgtctgcctgcgccctgtccgttattttgatggcgtcccttccccggttaaacgcccgcaggataccgatatggtcattttccgcgaaaacacggaagacatttatgccggcattgaatatcaagaaggttcaccggaagtgaaaaaagtcatttcgtttttgcaagatgaaatgggcgtgaaaaaaatccgcttcccggaaacttccggcatcggcatcaaaccggtatcgaaagaaggaacggaacggctggtgcgcgctgcgattaactatgcgatcaaagaagggcgcaaatccgttacgctggtacataaaggcaatatcatgaaatttacggaaggcgcgtttaaaaactggggttacgaactggcggaaagggaattcggcgataaagtcttcacctggtccgaatacgaccgcattaaagaagaaaaaggcgcggatgctgccaaccaggcgcagaaagaagcagaagcaaacggcaagatcattatcaaagatgcgattgccgatatcttcctgcaacaaattttgacccgtccgcgcgaatttgacgtcgtcgcaacgatgaacttaaacggcgactacatttcggatgcgctcgctgcacaagtcggcggcatcgggattgcccctggcgcgaacatcaactacgaaaccggccatgccattttcgaagcgacgcacggaacggcaccgaaatatgccggcttggataaagtgaacccttcatccgttattttgtcgggtgttttgatgcttgaacatttgggctggaatgaagcggcaaaattgattatcggttcgatggaaaaaacgatcgcatccaaagtggtcacatacgactttgcccgcctgatggatggcgcaagagaagtcaaatgctctgaatttggcgatgaactgattaaaaacatggggaaataacggacaaatgatttacggcaagccggctgcctttttacagccggctgacatttaaacaaagggggctcgtcatgctgaaaaggaaaaaaatatcggtcattggcggcggttttacaggggcgacaacggcgtttctgattgtccaaaaagaactgggggatgtggtgctcgttgacatcccgcaaatggaaaacccggtaaaagggaaagccttggacatgtttgaagcatccccggtacaggggtttgatgcaaagatcaccggcacgtccgattatgcagacacaaaggattccgatattgtcgtcatcacggcgggcgttgcgcgcaaaccggggatgagccgggacgaccttgtgcagacaaaccaaaagatcatggaaaacgtgacaaaggaaattgtgaaatactcgccaaacgccgtgctgatagtactgacgaacccggttgatgcaatgacctacacggtttatcaaacatccggttttccgaaaaaccgcgtaatcggccagtcgggtgtgctcgacacggcaagattccgcgctttcgtcgcagaggaactggacgtctccgtcaaagacgttaccggttttgtgctcggcggccatggcgatgagatggtgccgctcgtccgttacgcttacgcaggcggcattccgctcgaaacattacttcccaaagagcgcctcgataaaattgtggaacggacaagaaaaggcggcggggaaatcgtgaacctgcttggtaacggcagtgcttattatgcgcccgcagcagcattaacggaaatggtggaagccattgccaaagatcagcgccgcatcctgcctgccgttgcttatctcgaaggcgaatacggctacaacggcatttatctcggcattccggtcattttgggcggcaacggccttgaaaaaatcatcgaactcgatctgacaccggaagaaaaagcagcgcttgacaaatccgccgcctccgtccggaaagtcatggatgccctcgcataaacagaaaatcctgctccaaatccgcatgaagggtttggggctttttttcgcgtctgatcctctaaaaattgctggaaaaggtgatgatcgcgccttttttagcggcaatatttcatttatttttttaaaagcgccgcgatttttcctttgcgccgaatcatggtaaaatggggaaaggaatatgaacggatattctccatttttccgggaggttttggttttgaaaaaattgattttaattgatggaaacagcattgcctatagggcgttttttgctttgccgcttttgaacaatgacaaaggcatacatacgaatgcggtttacggctttacgatgatgctttccaaaatattggaagaggaaaagccgacgcatattttggtggcgtttgatgccggcaaaacgaccttccgccacgaaacatacagcgaatataaagggacgcgccaaaaaaccccgccggaactgtccgaacagttcccgctgatccgggaactgctcgatgcccacgggattgaacggtacgaactggaaaattacgaagcggatgacattatcggcaccctgtcgaaaaaagcggaagaagaagggtttattgtgaaagtcatctccggcgacaaagatatgacgcagcttgtttcgccgaaaacaacggtaatgattacgcgcaaagggatcaccgatatggaagcctacacgcctgcgcatgtcgaggaaaaatacgggttaacgccgcaccagatcatcgacatgaaagggctgatgggcgattcatccgataacattcccggcgtgccgggcatcggggaaaaaacagccattaagctgttaaaacagttcccgacggtggaagagctgcttgaccatatcggggaagtatccgggaaaaaactgcaggaaaaattggaggcacacaaagaacaggcgctgatgagcaaagcactcgccaccattcaccgcgacattccgctttccatttccattgaacaggcggcatacaggcacgccgacccggaaaaattacggcatttgtatcaggaattgggttttaaatcgatgcttgaaaaaatgggcggggacaccctgacggaagaaaaaccggcactggaagccatttctttttccattgctgaagacattacggacaacttgtttgccgatgtttcttctttttatgtggagattctcgatgaaaattaccatactggcgagatcatcgggttcggtttaaaaaacgaaaaaggtctctttttcctccgggcggaagacgcactttcttccgaagcgttcaaaaaatgggtggaagatgaaagcaaaatcaagcatgtctacgatgcaaagcgttcgattgtcgctttgaggcggtacggcatggaactgcgtgggaccgactttgacttgctgctcgtttcctatcttttgaatccttccgatacggtcgaagattttgcctcggtggcaaaaacgcatgattatgggaacgtggaaacggatgaggctgtctacggaaaaggcgcgaaacggaagctgcccgaggaaaaacggtacgccgagcatatttcccggaaagcggaagcgattgatgccctttgcgaaccttgcacaaaaacgctcaaggacaacggccagcttgaactgtttgaacaactcgaactcccgctttcccttattctggcggatatggaatacaccggcgtgaaagtcgataccgaccggttaaaagaaatgggcgcagaatttaaactccggcttcatgaaattgagcagcggatttacagcatggccggcactgaattcaatatcaattcgccgaagcagcttggcgtcattctttttgaaaaaatggggctgcctgtcattaaaaaaacaaaaacgggctactccacgtctgccgatgtgcttgaaaaactggagcctgcccacgaaatcgtcagggaaatccttcattaccggcagcttgggaaactgcagtccacctatattgaggggctcttaaaagtggtccaccaagatggcaaagtccatacgcgttttaaccaggcattgacgcagaccggtcggctcagctcgacggatccgaatttgcaaaatatcccgatccgcatggaagaaggccggaaaatccgccaggcgtttgtcccgtcggaagaaggctggctcattttttcatcggattactcgcaggtggagttgcgggtgctcgcccatatttccggcgatgaaaagctgattgaagcgttccgcgaaggcatggatatccacacgaaaacggcgatggaagttttccatgtaaaagcggaagaagtaacgtctgagatgcggcgccaagcaaaagcggtcaacttcggaatcgtatacggcatcagcgactacgggctatcgcaaaatctcggcattacccgcaaggaagcaggcgaatttatcaaacggtattttgcgtcctacccgcgcgttaaggaatatatggatgaaattgtcagggaagccaagcaaaaaggctatgtctccacccttttaaagcggcggcgttacttgccggaaatttcaagccggaatttcaacttgcgcagttttgctgaaaggacggccatgaatacaccgatccagggaagcgcagccgatattattaaaaaagcgatgatcgatatggcaaaaaggctgaaaaaagaaaagctgcgggcgcggctgctgctgcaggtccatgacgagctgattttcgaagcgccggaagaagaaattgaagtgctgaaagaaattgtgccagaagtgatggagcatgccgtagatctcgctgctcccctgaaagtggattccgcatacgggccgacctggtttgatgcaaaatagctgcaggcaacaaagaaaggaaagaggaatcaagcatgccggaattaccggaagtggaaacgatacgaagaacgctggcacagcttgttgccggtgaaacgattgaaagcgtaacggtacttttgccaaaaatggtcaaaaagccgcttcacacagaggcgtttgccgatgctctggccggtgaaacgatccgttcgctcgggcggcgcggcaaatttctcattttttacacggaccattacgcgcttgtctcccatttgcgcatggaagggcgatactgggtttatgaccaaaatgaaccggttgaaaagcatacgcatatgatttttcattttcaatccggaaaggaactaaggtacaaagatgtccgcaaatttgggacaatgcatttgtttttaaagggggaggaattgtcctctctcccgctttcaaaactcggccctgagccgctatccgatacgtttacggaaaaatatttatacggccaactaaagaaaacggaacgcaatatcaaaacctgtttgctcgatcagacggtcatttccgggctcgggaacatttatgtggacgaatccttgttccgtgctcacatctatccggagcgaaaagcaaagtcactgacaaaaaaagacgtgcatcttttacacagcgagatcattcaaacgttgcaggaagccgttgaaaaaggcggcagcacggtccgttcctatgtaaattcgcaaggacagatgggcatgttccagctcgagctgtatgtttacggccggaaaggggagccgtgccggaaatgcggcaccccgattgaaaagatggttacagcaggccgcggcacccattactgcccgaattgccaaaagaaacgcagataacggattgaacattggccaggccccctccatacactgatagcagcgatgcaaaacggaaggggcgatggccgtgggtttccggctttcgattttgctattggcattggcggttagcatggataatttcagcacaggttttacatacgggctgcggaagatgaagattccgcttaagtccctcctcatcatcgccgtttgttcgggggcgtctttatttctttccgtgctgttcgggaagagcctgctccactggattcgcccggaaacggcaaaccggattggcggcgtgattttaattttgatcggggcatgggtgatggtccagttttttcggtcaaacgacgaaaaagaagaacccggggaaaaagtcgtgctcaactttgaaatccgctcattgggcgtcgtcatccatattttgaaaaaaccgacgagcgcggattttgaccgttctggggccattaccggcatcgaagcggttatgctcgggattgcgctctcgctcgatgcattcggtgccgggatcggtgcgggcatcatgggctactccccgtttctgctcagttttcttgttgccggtatgagctttttgcttgtctcttccggcatccggctcggcatgctgttttcccggctgcaatggatccggaaaatttcctttataccaggtgttctcctcattttgatcggtatatgcaagttttaacaaggcaggtgggaatatggcaaagattatcggcttaacaggcgggattgcaagcggcaaaagcacggtgtccaatatgctgaaaacaaaagggtttacgattgtcgatgcggatattgccgcaagaaaagtggtcgaacccggcgaaccggcgtatgaacaaatcattgaagcgttcggcgaagggattttgctgcaagatctcacgcttgaccggaaaaaactcggggcactcatttttgcggatgaagcactccggatgaaactaaacagcattgtccaccctgcagtccgggcctggatgacgcgggaaaaggaccgggcaattgaaaatgggaaaaaaaccgtctttctggatatcccgcttctttttgaaagccggcttacctatatggttgaacgcaccatcctcgtttacgtggatgaagagacgcagttaaagagattaatggcccgaaatggcctttcagaaaaagaagcgcagatgcggatccgggcgcaaatgccgctgagcgaaaaaaaggcactggcggatgcggtgctcgacaacaatggcagcctggaggaaacaaaacagcagcttgaaaaaatcgtgtcagaatggaagctcgttccatgatgggtacatcatggttttttttatgcaaaaataggggaataacgctacataacttttaaaatatgatatactaattgatgaataatggattaaaagtatgtcatttattattcgaaggagttgtctgcactgtggaaacaaaaattgcgattaatgggttcggccgcatcggcagaatggttttcagaaaagccatgatggatgacgctttaaatattgtggcggtgaatgcctgctatccggcggaaacactggcacatttgattaaatatgactccatccacggcgtatttcccggagaagtggaagtggaagaagaggaagcactcattgtaaacggcaaacgcattcggcttttggcggaacgcaatccggcccaactgccgtggggaaaaatggatattgatgtggtaattgaagcaaccggaaaattcaatgcaagggaaaaagccgcgctccatcttcaggcaggcgcgaaaaaagtattgttgacagcacccgggaagaatgaagatgtcacgattgttttaggagtaaatgaaaacgttttagatatcgagcggcatcatattatctcgaacgcttcctgcaccacaaactgcctggcaccagtcgcgaaagtgcttgatgaacaattcgggattgtaaacggcctgatgacaacggtccattcttatacgaatgaccagaacaatattgacaatccgcataaagatttaaggcgtgcccgggcctgtggcaaatcgatcattccgacgacaaccggggcggcaaaagcgttaggccttgttctcccgcaactgaaagggaaactacacggcatggcgctgcgtgttccgaccccggatgtatcgctagtggaccttgtcgtcgatttgaaaaaagaagtgacggcggaagaagtgaatgatgcatttaaggcggcggcgaaaggctcgctgcaaggcattttggactatacagaagtgccgctcgtttcttcggattatacgacaaatccgtactcggccattgtcgacggcttatccacgatggtcatggatggaagcaaagtcaaggtgctggcctggtacgataatgaatggggctattcttgccgcgtcgtacaactggcacagctcgtcgcggaaaaaatggaagaaaccgggaaaatcaatattgcctaagccgaacggagcagcaccagcctgctccgttttcgttaccagttttcagagccgcgccggaggatgacttgtgcgggacgctgacgaaatagaagtgtaaacctttctattctattgatggatagatgaaaagtgaggacttttccggatatacaaacagaagatacatccaatatgttctgcatggatgaatttctttcgggaataggatgaacctttctgttgtctattcaccttcttttatatatgatggtagtaagaatgtatcagaacggggggttcatatgaaatgtccgtcttgccatagcaacaatacgcgtgtgatcgattcaaggccggtggacgaaggccgttccatccgcagaaggcgtgaatgcgaagactgctcgtaccgcttcaccacgtttgaaaaagtggaagaaaccccgctcattgtcgtgaaaaaagacggcaaccgcgaagaatttaaccgtgagaaaattttgcgcgggctgattaaagcgtgtgaaaaacggcctgtgtcgctggaccagcttgaaaaaatctccatggagatcgaaaaagaaatccgcaggcaaggatatacagaagtcagttccaccctgatcggggaaatggtgatggacaggctgtcgaaagtggatgaagtggcctatgtccgctttgcttccgtttaccgccaatttaaagacttgaatgtttttctcgatgaactgaaagaattgctcaacaagaatgcttaaacggagtgccttttatgaaaccgatttggaatgaaatacagccagctgaccgttatcgtgcatcgtcaaacggcctgcttcaggactacgatcaaaaggtcatttcgctcctgtaccagccgttaatcgggccgcaatgttacagcctgtatatgacattatggaatgaagtggaagtcggccggctctggtccgaagactggaaccattaccatctgatgagctttttatccatgaatttgtctgaaatttacgaagcccggctgaagcttgaaggcattgggcttttgaaaacatatatgaaacaaacggacgacatccgcatgtttatatacgaactgcagccgcccctgtccccggaacagtttttcaacgacggtttgttaaatgttttcctgtaccggcagctcggcagaacacatttccagcggttgaaacacttcttctccgaccgcgccgtagaaccgggtgagtaccgggacatcacccgctcattccaggatgtgtatgccgcaaaaatcggccccgaagtgctgaatgaggcggaagcgcagcaaatcagccgactggaagaaaaccgccgctatatcgaaaaaaccgccgccccggtcataaaaatcgaaaacacccattttaattttgaccttttatatgcaaacttacgtgatgaactgattccgctgcgtgccattacgccggaagtcagagaagcgattgtgaagctttcatttttatacggtttaaatgaactggacataaagaaaattttgctccaggcattgacggcagacttggaaatccgggtggaagatttgcggaaaatcgcgcgcagctggtaccagattgaacatcatgatgaactgccgcgccttgttgaccgcttccagccagaagcggatgcgaaagaacgaaaagagccggaaaacgatgaggagaaatttctccgctacctggaaacgacttctccgagacaaatgctgatcgatttttcgggcggcagcgaaccggcgaaagcagatcttgccgccattgaagaagtcatgtttgcccagcagcttccccttggcgttgtaaatgtactgatccaatatgttttgtttaaaaccgatatgaagctgtcgaaaaattatttagaaaaagtggcttcccactgggcgcgcaaaaaactgaaaaccgccaaggaagcgatggcgtttgccaaaaaagaagaccgccagtacaaacaatggctgaacaataaagagaagaacggcaccggacggagaaagccggtccgggttgaaaagctgccggactggtttaaaaaagaagaccaaaaaaccgctgcggccgcggtccaagccgatggcgagtcattggaagaaaaaagaaaaaggcttgaaaaaatacgtgaacaatacaagaaagggtgaaggcggtggaaaacataaatgagacactcaaaaggctttcatccaatcctagtttccgcaagcgttatgaagaaatgaagcaggaaatcatcacgcatcccgacatccgcgcttttttggatgcacaccgcggggaagtcacaaggtcgatgattgaaaaaagctggatgaaactgtacgaattcatttcacaggaaaaaaactgcagccggtgcaaaagccttggcgaatgcgtgaatatgatgaaagggtatgtgccggaactcgttattgaacatggcaatattgagatccactataaaaggtgccagaagaaaatattggaggatgagcgcaataaaacgcgcaggctgatccaaagcatgcacatgccgaaaaaaatattggaggcgtcctttggtgattttttccttgaacaaatggggcgtcttgatgcatacgattttgcgcatcgctttgtccgtgaatacgagccgggcaaaaaaatgaagggactatatttatacggcaatttcggcgtcggcaaatcgtatttgcttggtgcaattgcgaacgagctggcggacctgaaacaggtctcttctttaatcgtgtacgtgcctgagtttttccgcgaaatgaaggactcgatcggcgaccactccaccggggaaaagctggatacggtgaagcaagtgcccgtattgatgctggatgatatcggtgcggaaacgaactcgagctggacgcgggatgaagtgctcggcccgattctccaatacaggatgcaggaagaccttcccactttttttacatccaatttcagctatgaggatttagagtaccatttcacttatacccagcgcggggaaaaggaagaattgaaagcagcgcgcattctcgagcgcatcaaatatttaagcgcccctgtccgaatggaggggccgaaccagcgggcctgacccttgcatgagggggcccgcctttttcatttcgtaacgctttcccgtcttctatttgctgatgccacttcatatacataaggtaaagcaaacgagaatgttttaccgtacagggggggcttggattggaattcctgatcagggacaaggatgatgcattatggttaaaagcctattttgcaaaggaaaaacggcgcactgtgaaaatccgggaagcagtgctgcatgggaaaatacattatgttgtggaagcggccggcaataaacaggaactgcaggcagccgttgcaaattttattatgaagaaaaaaagaaacgagtggatttgtaaccaactgaaacaagcctatttttttcaggcggaagaagagcaaaaccggatactcgaaatcgtagacggcatgctgaaaggagagcggccggagctgacggatctggcgggtgagatcgacgaacgcgccgctattgaaggagcggtcgcaccgctggttggcgaatcgtgcacattgccgctcgcttccgtgctgacgttccgcttaaaaggctattttgactgtcttgaccgatacatcggcattgcgattgacgaatacaaaatggaacaggaataccagatttttgtgcaaagccttagggattacttaaagcaaaaagaaccaaaaagggaaaaaataaagctttgcctcggggaacaggtgaaattttacaacggccaattccgggaaatgacgagggaagaactgaacggattgattgaccgcaggcttctgtccaaccaccctgtctatattgactcagtcacaattgcaccgcttttatcgattgcgcccagccggattgaaatttatacggatacgccggaccaggctttgattcgtacgatatgcaatatttttgaagaacgggtggccgtgaaaagccggatgcattttatgcacgatcaattcgccgccagtgaataaaaagggggcttgaaccgggggcaaatgcagcacggcaacaaaatcaatcgccatcccttgattttttcattgcaaacttctataattacttacataatcaattggaaatgaaaaagtcaatgtgatgacgaggacaacaggattctgttaccgcctttcagagaggaaagcctcaggctgcaagctttccggcacggacaggatgcttaccgcctccgaacttcagtcgtgaacaaaatcagtagcggctgacggatatttccgttatcatactcaagccgcgcgtaaagacgtgcggaaatgagggtggaaccgcgtgtacaaaactcgtcccttgccgggggcgggttttttattttttggctgtgttttcgtgcggacgtgctcgtacggatgcctgcaaaaagcagcctcgtgcaggccgcccgcgtgacagcttaatttttaaaggagtgggacatatggcagagatcgtaaaaatcacttttccagatggtgctttaaaggaatttccatttggaacaacaacggaagagattgcccaatcgatcagcccgggcctcaggaaaaaggcgctcgccggcaaactgaacggcaaactgctcgatttgcgcacaccgattgaagaagacggcgcaattgaaatcgtcacccctgagcatgaagatgcgctcggaatcttgcgccacagcacggcacatttgatggcacaggctgtccgccgcctgtacggcaatgtcaagtttggtgtcggccctgcaattgaaaacggattttactacgacatggatcttgaagtgtcactcacgccggaagacttgccgaaaattgaaaaggaaatgaaaaaaattgttgcggaaaatcttgaaattgtccgcaaagtcgtatcccgtgacgaagccagaaaaatgtttgcacatgatgaatacaagcttgaactgattgatgcgattccggacgaaacggtcacggtttatgaacagggcgaatttgttgacctgtgccgcggcgtccatgtgccgtcaaccggaaaaattaaggaattcaagttattaaacattgccggtgcatactggcgcggcgacagcaacaacaaaatgatgcagcgcatatacgggacggctttcttcaagaaagaagatcttgaggcccatttgaaattcctggaagaagcaaaagaacgcgaccacaggaaaatcgggaaagaactcgaacttttcacgaactcgcaaaaagtcggacaaggcctgccgctctggctgccaaaaggcgcaacgatccgccgcaccattgaacggtatattgtcgacaaggaagtcaaacttggctatgaccacgtctataccccggtgcttggcagcgtggacctgtataaaacgagcggccactgggaccattaccaggaagatatgttcccggtcatgaaaatggacaatgaagaactcgtgttgcgtccgatgaactgcccgcaccatatgatggtgtataaaaatacgatccacagctaccgcgaattgccgatccggattgccgaactcgggctcatgcaccgttatgaaatgtccggtgcgctctccggcctgcaacgggtgcgcggcatgacattgaatgatgcccatattttcgtgcgtccggaccagattaaggaagaattcaagcgcgtagtcgaactgattcttgaggtatataaagatttcaacattaccgactactcgttccgcctgtcgtaccgtgacccggaaaatacggacaagtattatgatgatgatgaaatgtggaacaaggcacaggcgatgctgaaagaaacgatggatgattttggttttgactattacgaagcggaaggcgaagctgcattttacggcccgaagctcgacgtccaggtccgcacggcgcttggcaaagacgaaacattgtcaaccgtgcagcttgacttcctgctcccggaacggtttgacctgacgtatgtcggggaagacggtaagccgcaccgcccggttgtcatccatcgcggcgttgtctcgacaatggaacggtttgtcgcttatttaatcgaggaatacaaaggggcgtttccgacatggcttgcgccgattcaagtacaagtgatcccggtatcaccggatgcccattatgactatgcgcggaaagtccaagaagcgctcaaggcggaaggggtccgcgctgaacttgatgcccgcgatgaaaaattgggctaccggatccgtgaagcccaagtgcaaaaaatcccgtacgcgctcgttgtcggcgaccaggaagccacagacaatgcggtcaatgttcgcaaatacggcgagaaacaaacggaaacggtgccggtggacacattcctcagcaagataaaagaagaaataaaacggtaaaacagacaagaaatcacgcaccctaaaggaccacaaaaaggtttgcagggtgctttttattatataatagaggaaaaaatgggttggcacaggggaaggggacggagcccaatgcacttatttcggaatcgtcattttaatgcgttgttttttggcaggctgttcaccaatattggggatagtgtttattatattgccatgatgtggatggttttaaaattaggggggaactcgacggtctataccggatttgccggattcttattttcgctgacagaggtgctgagcttattttacggcccggttcttgacaaaataaatgcaaaaaaattgctggttacagcaagcgttttacaagccggcttactgcttcttcttgttgttttaagcaagtatggaatcatgaatgtctggctgctgttgctttccatcccggttctttcgtttttatcggaactgacttacccgttagaaagcgtattattgccgaaagccgtggaaaagaaagatctcgtcaaggccaattcactcatgtccattgcatataagggttcggattttttctttaatgggattgccgggtttatcctcgccgctttctcgatgtcgatggtgctcgggatgaattcgcttctttttatactctcatccattctgtttttgtttttaaaagtacaggtaaaaagaagcaagcaaaccgggagcgtacgggaagaatggcaggcgtacaaacgggattttaaagaaggcctatcgtttgtcaaacagcctttcatcttgcaattattaatccccttgctgtttttaaacttttttttcgcaattgtaatggtcgtattgccttctttcgccaatactgcgggcgaaggcgcttcatcctacggcatcatgacagcggctttgggtttaggggctttggcgggagcggcaggcgcggataaaatcagccggatatttccgtttggcaaaatattggctgcaggctttttgctctccgggttgtcctggcttttcatgattttattgagcaatgtttcgatatggtatgtttatacgcttatgtttatttccgagttatctattggtgccatcaatgttttgttttctgccatatttcagcaattgcctgatgaacaaatgttagggcgggtcaataccatcaacgtgagtttgctatcgcttgcgatgccggcaggatcattgatcggcggcgtgatggccaagatcacttctgtccagcttaccatgagcttttttggaatagggttgtttgtcctggcactgttttatatgggaagcggaagaatgagaaaactgccaaaagttgtggagattgaccatacgtatgtgaaattaagtagataaaaaaggagataaatggaaggtacaaccatcattcagaaaaatggattgaaaccggtggcatggttaggaggggaaaatgaaaaattgatttacatttgatccaatttccgttcattttatataaaatgccgctctcttgcctaccgaaaaaagcatgtaaatagatgctcaggcttgatgtaaaagctttatttttagaagcttttgtttcaacaaagacaagcattttcattaagcacttcagagaggagaccaaaaaaacacttgcgatttctctgccgttttgataaaataacgcatgttgagccaaaaaaagttaaacagattttccgggattcttgcaaattgacatggatacggtaaagtgatacaataattgagtgaaattgaatataagtttgtgaaaagaaggagcagcccgcttctcacctgttgacgcaatggtgcagttgtcaggtatctatcaatgatcgtgatcataagcgcgggtgtgttccctgcgctttttttcgtgtgcagtacgttcagggctttttcgcaagcgaaatattcacacgtttgtttgaaattatcttggaggtggctcattattagcaaagacatgatggtgaacgaaggcattcgtgcccgcgaagtccgtttaatcggccaaaacggcgaacagatgggagttaaatcccggaacgaagcattggagattgcggcacgtgccaaccttgaccttgtacttgttgcgccaaacgcaaaaccgcctgttgcccgcatcatggactacggaaaataccgtttcgagatgcagaaaaaagacagggaagcacggaaaaagcaaaaaatcattaacgtaaaagaggttcgtttgagcccgaccatcgaagaacatgactttaatacaaaactccgcaatgccattaagtttttggaaaaaggcgataaggtaaaagcctcgatccgttttaaaggccgcgccattacccataaagatatcgggcagcgcgtcctcgaccggtttgcagaagcatgtgccgaagtcgccacggtcgaatccaaaccgaaaatggacggacggagcatgttcttagtgctcgcaccaaaaacagagaagaagtaacgtcaacttaaggaggactaatcatgccaaaaatgaaaacacaccgcggctctgccaagcgttttaagaaaaccggctccggcagcctgaaacgttcccacgcttacagaagccatttgttcgcaaataaagtgacaaaacaaaaacgccagctgcgtaaatcaacgcttgtatccgaaagcgacatgaaacgcatccgccaaatgctcgacaatctgtaagaaaacaaagctttcaattaggaggaaaagattatgccacgtgtaaaaggcggtacagttacccgcagacgacgcaaaaaagttctgaaattagccaaaggttattatggttcaaaacatacattatttaaagttgccaatcagcaagtgatgaaatcctacatgtatgcgtatcgcgaccgtcgccagaaaaaacgcgatttccgcaaactgtggattacccgtattaacgctgcggcaagaatcaatggcctttcctacagccgtttgatgcacggtttgaaacaggcaggcattgaagtgaaccgcaaaatgcttgccgacctcgctgtgaacgatgcacaagcatttgccgaactggcaaacaaagcaaaagcagcattataatcaaaaaacagagcttccggcatgccgggggctctgttttttaaaaaaagcattataaattttccgtctgctgtctgatttcttcctggttcaaagtttcgtttgcagcttccaaattggcatgttcgtccactgactcgcccggctgaaattctttttggtcggatgcgattgtcatttcaggctctgccggaatttttggcatctttttcgtcattttaaccaagaatagtcccccttctggtaaaaaatttccggattccccggaaaaaagtaaaaacctgttttagtttgatataatcatggaagaactatacgaggagcgatttcaatggatgatgtcttaaaagtaaaattattgcatcctgatgcacaactgccgcaaagggccaatcctggagatgcagggctggatttatattccatcgaagaaaaaaacattgcgccgggggaagcggaactgatccgtaccggcattgccatcgagctgccgcgcagaacagaggcgcaggtcaggccgagaagcgggctcgctttaaaacacagggtcaccgttttaaacagcccgggtacgattgatgaggggtacagaggagaaattaaagtcattttaatcaactttggaaagacgccattcaaagttgaaaaagggatgcgaatcgcccaaatgattatcgcacccgttatgtctgtcaccgtaagcgttacggaacagttagcagaatccgaaagaggggaaggcggatttgggtccaccgggattaccaaaataaatgaaaaataaaatttcttttcgtgagattttttcaacgaaatttaatctgtgcatggtatagtggttcctgagcaattagatccgaataacgaggaatcctatgaacagtttaatacactttataaaagagcatgcatttgaactggctgcagtattgtgttttgcgctcccgcctgttggtctgtttatcatgcttgtattcagcctttcggaactgtacaggcatatcaaaaataaacggttgttttcatcttcccctgtctcctttttctttctctgtcttttggtagcaaccaccggggcggctgtgcaaatgggagaaccgctccttcttgctgaaagcttaaggattttgttttactggggaattttccttaaaattatgggcagcggaacaagaggcagattcaagcaattccgctggatcgtaatcggctgtggcctttatggtattttcattggctggcttccaaaaatgctgtcggatgatccagtactggcatttctgaccggcacggagctgttcggttttaaacattacaacagattaatcggcagtacttacaatccgaatttcacgatgttcctgctactggtcgggatttcatttctgtttgtggagatgctgaaagacgcgggcaagaaagactggaaaaacatgagctggaaatgtatcccgctttttttccttagtaaaggcgtttttgatactggatcacgggccggttttatttcaatgatatgcatttattttattttctttttcagatggaataaatggatttttggaggcgggcttctgtttctggcgctcggagcaggcaagcttgcggcggtcatcccgagagttcattccattgaaggttctctaacgggcagggaaaagatctggtatcattcctataaaatttttgaaacccactttttgtttggcacaacaccacttggtttcgggaaagtatatgccagcctgttccataaaaatatttaccacgcccatgatatttttatcggtttttttgtcgaatacggggcaattggcggtattgcttttcttgctgtattagtcatggggatgttcaaattgggcagattatttttcataaaaagaaattatcgttacttgaacatttttctgctcagcctgccggtaatcgtcctgaccggctttctcgatgaaccagttttctcgccccaaatcgggatgctggcagtagtgcttttatcctactgggagtggtattcaaagcgaatgtttcagccgcatgtcgcgtttttaaacaggctaaacgtcaaacgcaacgtattaaaacggcagcttcccaaaccggaactgcagtctatcagccgggccatcacgggagaaataaaagcgattgaatccgtggtccatgaaacggcagagccatttgaaatctgcaaaaaagaagtcaggaacaatcggggcaaaccggacgaaaaaacgccggacaaagagctgagtgataaaacaccggataaagaaaacgaatagagggacaagcatatctgtcgtgtgaagtggcactgcatgatcaaacttgctttccaacaggcaaaaaacgtccctacagatgttttcaggagcgtttgcagatttgccggctagctgttcaagataggttgaggatgagaaatccgttcaaagtggaaaaaaggttacgaattgcccaaatgacgatcgcgccctggaaacggttagctgaatccaaaagagggaaaggcgaattcgggtccacagaataggctgcgggagaggacatggaccgagccatttctaaacggattggaaccggtaaaagaatgaaaatgggcctgcgtaaatgttcaagaacaggatcaagaaaaaatgcgtctcatttttaaaatggattgtcgcatactatactagtatagtaaccaaaaaaagagtgataaaaaaatgacgtatccacgatctttttcacatatcggcctttccgttcctaatttggacaaagccgttcaattttataccgaggtgatgggctggtacgtgatcatggaaccatctgaaattaaagaagacgacagcgccattggcatcatgtgcaaagatgttttcggctctggctgggggtcgttccgcatcgcacacttggcaatgggcgacggaacaggtgttgaaatgtttgagttcaaaaacaatgaaacacctgacaataacttcgagtactggaaaacgggcattttccattatgccgtccaggatccggatgtagaaggcctcgtggaaaaaataaaagcgcacgggggtaaacaacggatgccgatccgtgaatattatccggggaaaaagccttaccggatggtttactgcgaagatccgttcggcaacttagtggaaatttacagccacagttatgaattgacatattcagaaggcgcttattaaggaggaaccggaaattgaaaggatggcttatcgggaaacctgcaagcattgacgacctcacatggggagaagtgccggatcctcgtgcaggtgaaggacagcttgttgtgaaagtgatgagcaccgctttaaacccggttgactaccaattgattgaatccggcaatccgaactgggtgtatccgcatataaccggtgtcgatcttgcgggggaagttgttgaagttggcccggatacgtctggttttaaaacaggtgacagggtggcatgccacaccgatttgaaccggaaaggggcatttgcacagtttgcggccattgatgcaaatgcagccgcaaaaatccctgatggcgtttcttatgacgaagcggtagctgtgctttgtgccgggatgaccgcatatcaggcagtggtgcaaaaattaaaccatactgacaagcaaacgattttgatccatgccggcgccggcggagttggcggatttgccattcagctcgcgaaagaactcgggttaaaagtattcaccaccgcttccgccgccaatcacgaatgggtcaaatcgctcggtgcagatacagcgatagactatcatacagaagatgtcacaaaaagaatcatggaagagacggacggggaaggggtggacctgatattgaacactgtcagtttcgccgaagcgaccgaagatttgaagcggctcgctttttccggccagctcgcatatattgcaggcgccccggacttatccggcataaagccgttcacgcttgcgccatcgattcatgaagtcgccctcggtgcagcccatgcgagcggctccgtccgggcaaagcaaaacctggcttttatggcggatgaattgatgcagcgtgtgaaaaaagggacgctgaatccgatggtcaaccaagtgctcccgcgtgaggaactgccggccggtttgaaaaccttaaaaggccgccacgtacgaggaaaaatcattgtcagaatgcatgaagcatgattctaaaagcgcccgctgccggacttgcgggtaccccaagcgggaacattcctgatttttgccggatttgatccattcccattcaaatatgaacatcaaaacaggcagtgtggtcacatcttgcatgttgatcacactgcctgtttatcgtcagctgactttaaatttattcatttcggtatccagcttgccagccagctcttgcaattctttcgctgattgtgaaataatctctgtaaaggcccgctgttcctggccggaagcagacatctcttcggaacttgccgcaaaattttcaactgtagaagttatctcctgaatccgcttcgaaatttgttttgatttttcgttgatcgtttcaatcccttctgcggtatgctgaaaactgccaacaatgttgctgtaagtatgttgaatctgatgaaaagcagcttccgttttgtggaacgcatctttttgttcatgtataaaggcgtttgctttgctaatattttcaacagctgcattcgactttttcgttgtcgtggcgatcaggtctttaatttcccgggctgcttttgatgatccttccgccagtttgcgaatttcgccggcaacaaccgcaaaacctcttccggcatccccggcccggctcgcctcaatggaagcattcaatgcaagcaggttcgtctgttctgcaatggaagtgataacattgacaaatgcctggacctggtcgatcatcccgctcagttctgtaatagactcgtttgccgtcgctgtgatttcaatattttgatctatttttttgaactgatggtcaatcgtattctgcccttcttttacggcgtcaagcgaagcagctgcatgttctgccccgttggcagcttcctgcgtaatggtttcaatgagattgaccacctcgtttaaagttttattgatgtcatggacggtttctgacagctgactgttcccttgcgcaaattcatcaatggaagaggctacttgattgatagattgaaaactttcttccgttctttttgagagggtatccgtatgggtagcgacctttgatgaaaattccttcaaccgtttggccacttctcttaaagagattctcgtttgcctgagcgccctggcaagcttgcccgtttcatcctgaaaagactgaattttatcgaaagacccattttcttcccgtaaatcaagtgccgctgtctgttctgccagttcggccgtttgcaggatcggttttgagattaccctacccagtatgtatgaaagaatgataccgatgataagggaaatgaaaagaccgattaaaacatttgtcggtatgattgcgattccggccgggggcacgtggtttccggtgccgctgtttcccttgccgatatttccgtaaaccgatgccccaatattaatggcaatcacaatcacagagttgagcactgagagcataatgatcttgaatgaaatctttttaacattctttaacataacgttcctccaccatttaaatctgtatgtagtatagaaaaaaagacttaaaaaagatttaatctttttgttgcttgcggaatccctaataaattgatcggcaaaaggagaaaaattttaatggggaaaataaaataaagtaaaatttccccctgcttttaaacaatcaaggaaaggcccaatgacgaaaaacagcgggaaccctttggaaaagggatcccgctgtttttcagcttccgatgggtacatcagcctttgtattttttaattaaatcaacaaatgcatctgtaaatgattgcaggaaccggactgtgccttcattcacaatttttccgttttcatcaaacagtgcagtaacattgccgatataagcttcaggctgctggaggattggcatgttcagacaaacaagcgactggcgcagatgatggttggcaccaaacccgcttaagtttccaggggattggctgataatcgccgccggtttcccatcccatatactttggccgtacgggcgcgaaccaacatcgattgcattttttaacacagccgggatggagcggttgtattccggtgttacaaacagcaccgcatcgagcccttttactgtatcccggaatgtcgtatactcggccggaacctggttatggtcatcaaaatcctgattgtataaagggagctttccaatctcgacaaattccgtttcatacccttcaggaaaaaggtttgctacattttccgcaagttttcttgaaaaagatgctttccgcaaagaaccgagcaaaattccaacttttgtcattctatcgacctgcttccatttatattttatgctagatcatgataagaaaaccactccggaaagtcaaaatttctgcttgctatgttgatatgtgccattcaagccagctggcggtttccggatgttcttggtgacaaccacaagcaatcgaaggtcaatgattgttcccggttttttgttccccgattaaagtattgaccagtcttccttatggtaatcaaaaataaaggaccgattttgcccaaacattttcggttttaacgggatggtccacgaggcaaatacaaaacgccttgccctttaggtttcacgcattcaatcagcagacgaaagtagtcacgcttcattcttcttgcgtaccgcgttctttgcagcaaggacgacgaatgaaggaagacggcaattatccatggaaccttcatgtagccgtgcgtgattctggcaagtctcgttgccttctgctaacgccatgttctttgcggcatgggcatctacgtaaaggaagcgggggaaattgagggtctttcttcacatagagtgcgtctacgttaaggaagcgtggaaaaaaggcagccttccttcacatagggcgcgtctacgttaaggaagcgaaggaaaatggtcctcttctttaacctagagcccgtctacgttaagaaagcgtggaaaaaatgagtcctttctttacatagagcgcgtctatgttaaggaagcgaaggaaattgaggttgttccttaacatagagcatgtctacgttaaggaagcgcagaaaaaagaaggcctttcttaacatagagcccgtctacgttaaggaagcgaggaaaattgggattgttctttcacatagagcccgtctacgttaaggaagcaagcaaaaacgaggctcttccttcacatagaggacctctaagttaaggaaacgcagaaaaaagtttcctttcttcatatagggcgcttctatgactgccttccctagcctccatctacaaacagcaggcaattgtatgccataccaaaaagggagctttcctgaaagctcccctttttggtgatccgtgtcaatgtactgcggtataagtgctttcgatttcccggatgcgccggttcagttcctcgttaaccggaacttgaacgccgtattttttgccgagtttgatgacggttccggaaaacaggccgacttcgctgtaccgttttgcctccacatcctgcgccattgacggcttaccggcagggctcaggtttccgaccactttcagccagtaacggagatcttcttccgtaagcggaaacccttctttttcggacaatgcctcaacttcccgcatggcggcaatcatcatctcgcgtgcagggccgtctttttggatttcgccgtaattgcttttgtaaacggcgacggtctggttgacgccgacattgagcatgaatttgccccaaagccttttcatcatttgggtatcggcttcgtatggcaaatccgtttgctcaaagaagcgggccacttttttcattttgtccgaaaaaaggcccggctctttttcgccgaagcaaagcatgcccatatgcgcatatgtcagctggtttccggttttgacggcatccatcccctgggcgacacagtataacattttgtccattccatatgtacggccaatgatttcttcgcttgagatcccatttaaggcagacaaaatcaccgtatccggcccgacatgttgtttgactgcttcaactgcctcgtccagtccgttgaatttgaccgtaaaaagcaccaaatctgccggctccactgtttcttccggtgtgacataatgaaagtggcatttttcgccgttacaataaacgccttcccgctcatatcgttcaatgcgctgttggtcagcgatgatccgcaagtttttcgccggcatttttttcgataaatgatgcccgaataaaataccgagcgcgcctaacccaatgatcgatactgttttgatttcagccattcccccgcctccttttttcattattttaccacaattccaacgaaatcgtcattcagactgcccgttccggatggccaggtattgctccagccctcttttgcgcaatttgcacgccgggcattccccgcagccgtcagcgatgatgccattatagcaggtcagcgtcttttcacggacaaaatcaaatgccccgagttcatccgcgagcgcccatgtttctgctttgttacgccacatgagcggggtatgaatgacaaactgctggtccattgaaaggttcaaggtgacgtttaaagatttgatgaaaatatcgcgacagtccgggtaaccgctgaagtccgtttcgcacacaccggttacgatatgccttgcgccgatttggctggcaagcaccccggcaaaagaaagaaacagcaaattccgcccgggcacaaacgtattcggaagctccccgtctgcccctgctttcacggtaatgctttccctcgtcagcgcgttcggggcgagttggttcaacagctgcatatccagaatatgctgctttaccccgagctcttccgctatattctttgcacattctatttcaagacggtggcgctgcccgtaatcgaacgtaacggcttccacttcctgaaactttttctttgcccagaaaaggcaggtggtgctgtcctggccgccgctgaaaacaacgactgctttttcttttttcattgataatcgtcctttcacacaaaacagcaccgaaaagggatgctgttttcttagttttttagagagggttttctaaaaacctcttccataaatgaaggattcttcccaattgattataccatggaacaggcgccatcttttaaagcatccgttctttttcggagtacggcatttttcacataaatgccataaacaaccggctttgctatgatccagatcacagtcatcggccggaccgttttttaagataatcatagtgattatctttatttgggagggacggctatgaaacgatatgtacaattatttttcatgtttgcggtgacggtgctcattgtaatgggcatccagaaagggctgagcacactgaatgtgttgaaccttgaaaacttttgggctaattatgtcgtatttttgattttagcctatatgattctgtcctttttccttcattatttttccaagcgaaaaaagcaatcataaaatttttccagcggttagcctgccgctggatttttttattgttttttgctattttgcattgcaaagtagttcattttttgataaactaacttgcataacaaagtagttgaaatgggggtggagggatgtccattcgaagccagttactgaaaggcattttagacggctgtgtgctggctgtgattgaaaaagaaccggtttatggctacattctttcaaaaaaacttcagcaattaggcctccaggaaattagcgaggggacgctctatccggttctgttacgcctgcaaaagaacggctggatccatggagagatgcagccatccgattccgggccgagccgcaaatattatgaattgacggaaaaaggaaaatccgcgctagatgagattacaacagagtggcagcaaatcgcagcccctgtaaatcttttattgaaaggaagaagtgaggatgcttagtgtaaaacagttgattgaggaaaacaaccgtaaacggcaggaactggcacctgagaacaaaaaattttacaacgatatgcttgactaccttcgcctgcaaaccgttttgtccgagcagcaaacagaagaagtgctgatggaactgcttgaccatctgctcgaaggccagaaagaaaacaagacagctgcgcaaatgttcggcggtgacccgaaagcatttgccgacgaaatcatcaggcagctgccgaaagaaaacaaacgcaatatggtttcttttacaatcaggataatgatcttgcttttggggattgatttggtcattaatggcattactgcttttgttgttgaacggttcttttccagacctttgccgccgttttatcctgtatccgcggccctgaactttttcattgccgggctatacgtgatctttgccatttggtatatctttcgtatcttgaaaaaaagtttgtttaaggaagagacaaaaaaggtgcaaatcctaacttttttgaaaatagatgccgtaatctttgtttttctgggcggcgttattttgctggataaattcatgccgaaaatcggcccgtccttttcttatccgtggtggttgccgctcgttttaggtgtggtgagtttaggggtttactatagctgggagaaagcagcaaagtcccgggggatatagttctagcgtgcaataaatctgttgttcaaaagcccgtgtgcggtttcgccacgggttttgcatgcgccaactatgttgcacgcaattgtgcgtaaaggtattgcaaaaaaacagcggggactgtgaaatatcttctttcagggagatgaaagacaaaatggtcggccaggattcttgaactgtctttcagcgggtggatgaaagacagttcgagaggctgcgatcttctaaatgttcttcaccgggtggatgaaagacaaaatgctggtgcggcaactagcaaaatgtccttcatcagattaatgaaggacaaaatgcgggtcggcctatctatttggcgttcagtctcattttttctccgttcggctacttggggctctgattagaattggttcgccagctttttattaaaagggcttacagccggccttcccttttcgctcgagtttttcactcggaaatttctgcttttcctgctgcttttttcgccgctttcacttcatacatgccgagttccatattgagcatatagtccggttttgacttgccgcggtttgccctatgtcctgcgatatggacatcgctcttttcccactgtttccagtgcgtttctgattcccatgtgatcatgacaatcacttcttcttcgccgcgcccttgttttttctgcatgatttttatatcaacaaagccttcctgttgttcgatgattcccggtttactgaatcgttcgataacctgatctgcatgtccttttgctaccgtcattcttcgtaattgtacaaacataaaaccttgttcacccctctttttcttctttgtccggtttttcttcgttatctgatttttcttccgcgccggctgctttctctctgatttcctcttcgcggatttcaaacagctctgtaaattcgttgatgaccatttcgattgcctttaactcgccgacaatcaccgggttaatggattgcagttccggtgttgcaagctgctctttcaatgtgttccgcttgatgttcagcctgtttagaaactcgattgcccttccacggcggaatgttttcgcaccgtgatgatggtgttttcttctgccatgttcctcttcacccggatggcaaggcccttcaaattttcctcccggtccaattgatgatctcatatatgtgctcctttctgtatacagttgtatacacaagtaattgtatacggttgtatacgttttgtcaaaggttgttttgcaaaaaattatgtttttaagttgaatttaagaatatggcactatatttttgatatcaaatgtgccggggtggagctgaagatgaaaaaaaattatgctaaatttgccattgatttgttcatggcgatcatgtttgttttgttctttaacaaaaatgttttaggcggacttgcgtaccatgaaattgcagggcttgtgttcggcgtcgtgtttttgacgcatgtctgcctgaatttaaactgggtaaaaaatgttacgctgaaaatgtttgacaaaaggttaccgtggaaagcgcgcgggagttacgcgctcaatctgttgctgctgatttccatgtgtttcattattatcagcggcatcattatttcacgcgttgtttttccgaacatcaaccttggaaatgaaggctggttcaaaacaacacatatttccgtttctttccttgtgctgattcttgttggcgtgcatgtcgggctgcattggcattgggtggtcaatgtatttaaaaggatggtccatttcaaggcgaaaaacaaatgggcaggttatgttgcaaaagtcgccgctaccctgattcttgtgttcagctcctgcgaaatcatacaaacagggttcctgaaccgcatggcaagcgccgcctctatttttggcggaagcacgggcaacagtgaaatggaagggcatcacgattttaatggcaaaagcggccaaaaatcggattttacaaacgggcaaaggctggatttcacgaacgggcagaaaccggcttttgcaaatggaaagaagccagattttgcagacggtgaccgcaggggaggaggggatcatgacggtggcagcgcgaatgtcttgactgtccttctcacatatacaggcatcatgtccgcatttgttgtgctcacttattatttgagaaaactcacggtaaggaagaaaagaagaaaaacggcttaacacggaaacaccgccggtttgcgcgccggcggtggaaatgttttactgtgaaaggggagcggatagtggaaaaaggtgatctcatccgcaaaatggcaaagatggaacttgaggaaagccaaacaaggcaggcagccctagattagtatccattcccgttcctgacttggaccgctatatgaaagcgcggaagcttcacggaaatttgcagacgagtggaatgaaaaactccatgcattcgaccgaaaagccctccaactcgttgaagaaagccgccgcgatgtgacagggcgatgaagaagctcatggaagccggggacaggagtttaacgggtagttcttcgcacaggaataccaatgctgaatttagcaggaatcatcaggggtgagagggtaaaaccttattgtttatagtgctggcaaatgcttgtaaaggttataagagatcatctgttaactcaaggttcctaaacgatgctattatttcctctatgtttaacaaaaagttctctcactcaagttttataattcttataaagggaactgatttataaggagcattcctgttagaaggactttcggggacttgaacaaaaagagccctcctggtatgatgcggggtgtcatctcacaacgaatgacccctaatttgtaaccaaggaggactccataatggattttaaacaaaattagaaaattaatcaagtcaccgaacaaacacttgtagtgggaattgatattgccaagcgtacaatcatatttataataaaagcattcatcaaattaatagatgtaatcacgaaaaaaacatcttaaaaaagctcctatataaatgaacaaaatatcgcagctccgttgcctgctgaataaagtaggcctcatgcaaattgctgctcatgcttgatgaaaaacttaagtttattttatataataggggctttttcttaacaccgttgttttcattttaaacattcgcatgagtaggcaccatcagcaactcggctttctacattaaaagaaagctcttttcgcggctacaagaagagctttctttcatttttaagccaattgctttttctttttaagtgatttgaagagtccacagcattttagcagtacatgcgttcatacggatccattcatccgctttagtcttttaaaatggcagccatggaggtccggaccatttacacttatctcatctctaaaattccccaaaccaattggttatttatttccagcaggatttgcatttttctttttgaacgcggttagaataagcataatggcaagaacagcaaaaattcctgtcgttatcagtacaacgcctcctaatcctcctaaacctcctaagaaaaggccgacaacaccatagtctgtatcagagaatgtagaattttcaaagccaagattgcctaataccggcatcaacgcaatcggcatgaaactaataacgattccatggatgaatgaaccgagtatcgcacctctgcgcccgcctgttgcattgccaaatacccctgctgttgcaccacagaaaaagtgaggaacgacacctggtaaaacgattatcgtgtggaaggcaatcatcagaaacatgctcacgattcctccgataaagcttgagaaaaagccgaccaaaacagcatttggggcatatggaaaaacaattggacagtcaagtgccggtttagagtttggaactaatttttcagaaatccctttaaacgccggaatgatttcgcctaagatcaaacggacacccgaaaggatgacaaacacacctgcagcaaaagtacctgccatttggatggcataaataataaagtttgttccatcgcttagttttgcttcaatatatcctttgccagtaaaaatagctagaattatataaataactcccatcgtaagcgttatggcaaccgttgaatcacgcaagaaggaaaggccttttgggactttaagatcttctgttgaatggttttgatttccgaaaaatttaccaataacagctgaaatcatgtatccaaaattaccggtatgtccaagtgcaacttcatctgtaccagtaacatttttcatgaatggctgcacgatagccggtgacaaggcatttgccattccgagaatcaatccgcctaaaaggattaagggtacggatgtaaaaccggataccgtcataatgaccgcaatcatacaggacatatataaagtcgcatgccctgttaaatagatatatttaaatctcgtaaaccgtgcaatgaaaatattgacaatcatgccaaccagcataatcaatgctgtcggtgtaccatattttgtgagggcaagggctacaatcgcctcattatttgggacaacaccctgaacggaaaaagcatgtttaaacatttccccaaatggtgttaaagaattctgtacaatacccgcaccccctgttaaaaccaggaatcctacaaacgtctttataccgcccagcaatatgttactgatcgatttcttttgaaggattaaaccgataacggcaattaaagcaacaagaagtgccggcgtactggcaataccaattaatacatttaaaaaatctttcatgatctcgtcacctcaatttgtctgaatgaaaaaataatgctttgttcattcatctttggttagatctggataaaaacgcatccatgcacgaattttttgcttatccatgaattattcaggcaaacgaccggattcttgcaaaaattgaaccactttttctttcaattcatttttatcaataatactttttaatactgttactttctcggctccaagtttttcagttgcctcagctaaatcctggccgacaaagaaatggtctgcagaatccggggtagcacttcccatatcgaagtgagtcacttcaatatcatcctgattaatccctaattgatctaaaatcgacttgatgttcatttcaatcatgaaactggaacctaaacctgatccgcatacagctgcaattttcattgaatattctcctcctctgtaataatggataaaatttcttctttcgttttcgcatgtaaaagttgctctaatttttcttccttccccagcaatgttgcaagctcggataatgcttttaagtgggccgtattatcgatggctgctaaagtaataaaaatcctaaccggatgttctttatctactaaatcaaccggtttatcaagcttcaacagtgacattcctaagtgcttgacaccattttcgggacgtgcatgcgccaaggcaatttctctgccaatattgataaacggcccatgctgattgacaacgtttatcatggcatcaatatattcctggttaattttgccctccattaagagcgggcttgcgctcttttgaatggctttcatccaatcgaggccatcattttttacaacttgaattgtatgatcagttaatagctcactcagcattggctgatagatccctcctgttccactcttgaagtttggtttattaaacagctgaattaatccttgtgttaagccattaaagtcatgaatcttcgcataatcactaacaacatccaaaatagatgagacaagttcatttcgataaatatcaaattgaacaagatttttggtgagtatttttaaatcctgatgatccgggatggaatgaactgtaatgacttttttatttttttccggaatgtttaccgtggaaatcaccaggttttcctgtatttccgattgttttaaatactctcgctctgtgattggaccttcaaaacttacaaatggaaacaacgattgaagtttttgtttcaagatggctgcagttccaacaccgctgctgcagacaagcaaaactttttgaactgcttttgtaggccagttttttctttgtttatcaatttccgcaccaaaataaatcgagattaacgagatttcatcttcactgatagaatgtttacaaaaggcttcaaaaggctgaatggagaatcttgtaaatgaaaatacattcccgtaattctttttgatctcctttaacagcctgttttgatacttcacaccatagcgcacccgatagtaacaagcaagaagatgcacgtacagattctttttcaattcataaatattatcgaaattgatgccggatatttgttgaaaacgtaaaatcactttttcaacgaccgtatccaatccggtaaatttttgcggtgcatatttggactccgaactgataaaattgatctggctgctcaaaagaagtgtttctatataaaagatttcgttttcatatacttcaggattaatatcaaataactttaacagctgcgaaaccagttcgtattcagggtacgttttcagaacatttaattcgtattcttttaatggtccgactgttctattctttttaattcgctgaataacaaacgggatataaaccgataaaatgtttatagcgtcgtccgaaaaatgttttcccgtcaatctttctacatcttctaaccatgcaccggttccacgtataaattgattttcagctttgcaatcgatgaagtgttgaaaatgttcactgcttatcatttttttgtacaaatttgagtgattgctaataaattcatgaaaccaccaacggatatcttcttcttttccgcttaaccagtagccgtgtttaggatcatttttaagggcaaggttggactttttaagcaggcttctggcccgatcaatatctgttatagcagtatttcttgagatattttcaagttcagacagcccttcaagggtaacttttttcgtactgattaaactaagcagaatatctatgttgcatctttcatcttttgaatatttaatcggtgttgattcttcgatggcatcctctgttttaagtattttttctttcgtttctttttttagatagtagccctcattcctgacattttgaatgggctccattttttttgcaagcaattctttatttagagcgttgaaaatataatagaccgttcttttggaaattttaaaggtgcttgataaatcttcaacagatgtgtatccttcttgatgtgctaagtagtttaaaatgagctttttcttggaagcgcccatatttttcactcccatttgttcctccttcctacattttcatcatataacaaatgttaaaacatgtaagcgcaatcagttcagaagactatgtgcaaaattgggctgcttaattgaaggatcaactaaaacagcacgactagaatggggagtttttctcagctgggcggaaattggaatatcttacagttaagttgaaaaaacaaatgaaattaataaaaagtgatggaaaatgtggcattggttatgtagatggcagttgatagaatagtttacgtccttgaagaacgaaaagtaacgaagcttgccggacgaatcagcttttggcctgttctgactcgtccagcaagctcgtccagattattgcttttaatactcgccttttatgacaaaaaatgacccccgtatggtgccggccagttttgacttttgtctggcaaatttaaatttcccttctaattcctttggtacttccatcccctcagaaagtttaaaaccaaccgcccgcttcttcggatcatctatggaatacattacattgacaacgaggccatcctcgtaaaagacgtaagcaaattggatattttccacttgaaaacgcgaagtttccaatggcttggctgcaaattcaatgccgcgttcttctttcaaaatcctattcacatattctagggtctctccgctttctgcagctggcaaaacagtaaatacgtgtttgtatttattcataaaatagcgcgcctcattcgcacgcaaaccggctagcgccttcgcaacaggtgaagactctagaccaacatcagacacatttttgaaatcaacgatataggacatgcgcaacgctccttttcctaaatggatttgatgtaaacacaacaatatataaaaaccattctatacttaaccgcttacaatatttgtcctcgctcaccagaaatgatcactgatatttttgggctctcacctagcatttctattataacaaaattggtagcactgaatggggaaattgctgaggcgagttttcggtgcaaaacatccatacaaatccggccgtgaccatttttgctaaaaaatcctggttgaatcatgtgcagaatctgctgtttttacatttcctacagcagcgattatttggataaaggatgtctcctcaaacccaagcttttgttttcaccaagaaaaaatctttcagctctccctcctattcatgttaagttaccttacataaaaaacaaagaaaacaccaacactggttctactttatctattttgaataataaatagataaagaattgtgcaaaatcgctaatgaaaaaccgtttatcctttgctatattaaaaatatagatgacattatatgtgatattaaacgacatcaaaagaaacattccaaattcactaccgtaaatctattgaaaaggagctgaagcaatggctactcaattggaaagtgcttatccgcaaccgcagaagaaggcgagtatggatccctccctgatcccgaaaacagatgcagacagaacagttggccctttgaattatatttttatgtggattggggacggggtcaatattggaaatattacgcttggtgcaagtctgattgtggccgggatggcgacattaaacatttatcaaacttttgctgcggcattgatcgccatcagtattatttcaaccatcttttcattgaacgacagattaggctacaaaacaggcattccgtacgttgtccagctgagaatgtccttcggcgtaaaaggttcgatattcacatcgctttgccgcgggatacctgccattgtttggtacggataccaaagctggattggcggcacggctttaaatgaaatggccaaaattgcaacgggcggagcttttgacaatgcggctgtttgctttatcgtgctccaattgtttcaaattgcgctctccctctatggctttcatgcgattaagtgggtggaggccctgacttcagtcgtgattttagctgcacttttctatgtgttcagcattcttctcacatcccatagcgccacgattgcaaacaaatgggtgcatgcaaaaggaacgtgggggctgccattctttgcttttatcatgacgtttatgggcaattatgccgccatctttttaagtgcagcggattattcaagagaattgaaagccgggatcagccatacaaaaagaaggttattgtattttattccgatctttatcgcatacgggtttgctttaacgatgggggccatgcttgcttctgctaccggaattacaaatcctgtaaaggctttttcagcagtggtcgataatccttatattacatttttcgtgtctgcgtttatcgtgatcgggaccgtttcggtgaatatggttgccaatattattccaccaacttacgtcattacattgcttacgaaattaaaatttaagtatgctgtcaccattacagggctgcttgcttttgcatcttttccatgggtgcttgtccgggattcttcagcaaaggggctcgacattttcattctggcttactcggcgtttttaggtccgattgtagccattctattgattgagtactacatcttccgaaaacaaaaggtaaatatcgccgacttgtacgcggaagacgggccttattccggctataaccctgcggctgtcatttcattagtaattggcgcggctgccgcatttgcaaaagtggaactggcatggatcatcggctttgttgcggctggtttagcctatatcattctgtcaaaatacgcatttccgttttcaaaatttaaaaaggatacaatttttcaaaacacagtcgttctcgaatcaaatcacagggaggggattcacaatgaaatatgatacgctcataaaaaatggaaaagttgtttttagaaacagcgttaaaatcgctgatcttgccatccaaaatggaaaaattgctgtaattgcggataaaattgaggaaacggcagaacaagtttatgacgcttcagaccaatatgtgatgccgggaatggtcgacatccatgtgcatatgtgcgaaccggggaggacggaatgggaaggatttgaaaccggaacaaaggcgcttgccgccgggggaacgacaacctatgtagatatgcctttaaatgcgctgcctgccacgacaacaaaagatgctttagaaaaaaagcttgccgctgccgccggcaaaaactatgtggactacgctttttacggcggattagtcccaggtaatctcgatcagttaaaagaactttccgattgcggtgttgttgcttataaatgttttatggccagctgcggaaccgatttgccgggagactttaaaaatgtagatgattacacgctttatgcggggatgaaaaaattagccgagctgggacatattttattgattcatgcagagaatgccgccattaccgatgggttagcagaggagatgatcaaacaagggaaaacaagtccggctgattatgttgcaacacggcctgtatttacagaagtggatgccatcaagcgggcgctatattttgcgaaacaaaccgggtgcaaactgcattttgtccatgtcagcagtgcggaaggggtggaagaaattacgaaagtgcggaacgaaggacaggatgtcacgcttgagtcatgcccccattactttaccatcacaacagcccaatttgcggaaatcggcccacttgccaaatgttccccgcctttgcgcagcgaagcggagcaggaaaaactttgggaaggattgaaacaaggaaaaatcgatatgctgacatccgaccattccccttgcccgcctgtaatgaaggacagcgaaaccggaaatatttttgaggtatggggcggcataaccgggtgccagaataatgtcgatttgatgttcgatgaggctgtcaaaaagcgcaatattcccattacgcaatttacgcgcatgattgcaaccaaccctgccgaacgttttggcttaaaatcgaaaggggaaattgcgctcgcaaaagatgcggatctcctctttctcgatcccgaccggccatacacggtaagtgcggaagacctctattaccgccataagcacagcccgtatatcggcagaaaaattgattgccgggttacgaaaacttttgtaagaggacagctcgtatttgatctggatggcggtggtatcaagggtgagccggttggcaaatggatccggccagcgaaggtttcagactatgccggagtgccgtcataatgccaacagcatcaggctctgctttcaagagcctgttgttgctggcacagatttcgggacaggaataaaaataacgcaagacagcttgctgttttcaagagcctggttttgctggcatggattttgaccggttatcaatggctggcaacctgtatgcaccatggcaaatgccttcaatcctccgtggtgcttcgttcaaatgtaaatgtaagaggaagctcgtattcaatctggatagcggctgtatacaggcgagccggttggcaaatggatccggccagcgaaggtttcagactatgccggagtgccgtcataatgccaataacatcaggctctgttttcaagagcctgatgttgctggcacagatttcgggacaggaataaaaataacgtaagacagcttgctgttttcaagagcctggttttgctggcataaattttgaccggttatcaatggctggcatcctgtatgcgccgtggtaatgccttcactcctccccggtgtttcgctcaaaacttacggttgcttacggtatgattgatcattctgtcccaccctttatttttttgtaaaacttttatcaaaacatagccaaaaatggcccctgcaaaagagcttaaaaagaaggcagggataaatccgaaaagcgttgacgcttggccgagtaagaaaacaacaatgggataacatgccaaggcaccgagaatgcctgtccccataacctccccaacaaaggcaaaaatgagcttattcgtcttcgcgtacagataagctgccaaaaacgcgccgatcatgcttcccggaaaggaaaaatactccctgtcccaagcaagttacgtaaaagcgaggatataaaagcttgcgtaaccgcataaccggggcctagcaaaacagccgagagtatgttggcaaaatgctgtaccggaaaaatttttgcaaaaccaaccgggatataaatcaagctgctggatacagttgtgatagctgcaataactgcagttgctgttattttttgtgtttttctcattagaaccaaccttccctcctttttagttgtgaatgaaaatcagaccggccagtcttgttttttatcgttcatatcccaaaataagtattcatactttgaggctatttgaaaatggcgttctaagactgccaattccgtttctgattttccgcttgccagttggtccattaagtcaattaaccactgcgttccggagccgaacgtttctgaagaataggtttcgatccatttcttgtaaggattggcctccaatgtgtctcgatgatttacttttagcagtttcccaatttcccaataatcccaggcacacggcaacaagcaggcaacaagttcagccaagcttccattggcggccacttgcagcatataactcgtgtaagcaaggttgatcggcgttggttgggttgcttctaaatccgtccgagtaacgccaaactcggcagcgtattggcggtgcagttccatctcaaaatgcaacgattcatggagcaccgcagcaaatctcgtcatcatgccgaggttacccgctttcacaacacccatggcaaacagttttgcgtactcaactaaatatacgtaatcctgctttaaataatagataaatttatctctttctaaagttccgttccccagtcccacgacaaaaggatggttatggtttttctcccaaatcggctggacattttgatatagtctttctgtaaaagatcgtttcaacaatgattcctccttgtttaccggaaagccgaatgcggtttgcaggctggtttcaccctttgccccgagcaatggcaggaggagcatcctcaaaataaaaaaaccgccctccatcggaaagcgggtgtatcaattacaaatcatcaggtgtaatttcatcacctacttcccttcgctagtacgaactagatcaggttcaaagggtacttctcagccaacccggcgcccctagtagattattatgaatattcatttacattactcttaccatatcatagtatcgtattttgtgcaacaggagatttattgtccgtcttttaagtttttgtaaaatatggaaacagagccaaagaatgttgactcaaatgctgcctgtaccacgcttcagttcccgagatacggtatttttattacagccaaccatatcagtgattacttgcatggatttccttctgcacgaagggtggcaatcttcaccatagataaacccccgtattgattgcgtttttatcgcaaacggtttatcatggtttttttcatttatttagcttgttgcatttgattatccaactagccttttgtaattttatcaaaaaagcctatataatctactattgcattttcaaaataatcacctaaataaatatcgaaatgtccacagtcatactcttttatcgttgctttcttggagcgttttgcacactttatggttgcccaagcaggtgctaatgtatctttccgacaaaccgcataaaatatcggtattcctatatttttagtgtatctactaggcgaatatttaaagaattctaaaaccgatcttgcgggggctttattcacaaactttaaattttcaggcatcaacttaaaaacctttttgtagtcagaaacagccatcatcgctactttccccggcgcatccaccaatttaatcatgaccggatgatacccggtaatagaagataaaacgtcagctatggcaaaggggaatatttttagggcagatagtggtgagaccgttttcactgtagctaaggtgtttgtatatgggcactgtgccacggttgcaagaatatctattcgatgagctgatagggttataacgtgtcccccactaaacgaacttccaaacaggagtattttactatcatcaatgctatcattctttttgatgaaatcaatggcagagttccaatctgcaagttgttcttttacatttatccgttgtcttttatttccgtcacttgctccatggttacgataatcaaataaaaagcaggcatacccggcagcagcaaacctttcagcatatgcgtccaaccgcatttcacgcactccacccaagccatgagccattacaatgaccgggcaccttttatctacattgggtagatatagccacgcgctacaccttgttccatttgaataaaagtcaatatcttctcgtcgaaattgattgttcatttttctcccttctcccgcttcaggcgagcacaaacattgcacgaaatagaattgacatatacgtataaaaatggctccacagtgaactactctcacttcgatgggtcactcgaagtaggggtttctcgacttatcgttactttacgagctaatgaaagctgaccaagcgatcctttttgttccaagcgtttatgtttcatactaacaccaataagcatatgccttcttgtttgtatccccgaatattgctcaattcgtccagcgcagtttgtgaccaaaatacacgatactctttgtccacgcttaagaccccttgaaacatctccgaagatacttaagcccctgttctttgctgtaaatgcgtccgtttcgccgatcttcgcgactcttttgaacctgacgaacaacttcttcatcttttgccagatattcaacttccttttcgtttagtgcttgttctccccgcttgaaggttaaaaattcaataaaatcatacacttcaaggacatcttgttcaggaatttgatcaatcatccgctttaattcttcacggctcactctcaaaacgtttcaccgccttgtggtttattttctcattatattttttaaatgcaaacacactccacatggctcaggtgctgtgagatatcaggacgtcctatccgttaagcagaatctgggttagccatgagacatcttttaaaacgatactcaatcaatagcgtttgcttcgacattgacgggcactgattctggcccggcctaaaatagtagtaccggccactttccctaatttgccgcgtttcggcactgtccaggaaatggccgaaaatggttaaaaatacttcaatttcaggacttatatttccggaaatctattttatcaatgtctttataattgttatgatctgctctatagctatccttagaggacgcctcacaaacacataaatattgttcaggatttagtaattaaaattgaacatccccttttgatgcatttccagatcttctaattttatgcctggaaaaatttgggagagtatgttgttcttacccgttgccctgcaggcggtcaatcagctaaatagttgccttccatattgtccaccggtctttttcaacgatgttattttcctttgtcacctttttctggacataatcggtcagcaaacttagttcttgatcatccagttcatacaaaatgcttcttcctgttctttcacttatgtcttttaataattgcgctttattttcgtgcacctttcttgtttcccataatttaacttcttcaatttttttgaaccctgcttcttgcaaagcctcgatgaccgtttggctgctatgcctgcgttttatttcctcatcaattaattttggaaataactcaaataaataccctctgatgtttgtgttatctccttctaataagcaatcatcgggtgtgcgatcttgaataataaaaaccccgccatcctttaacagtctgtgtgcttctttaaaacaagcatgcaaatcccaaagatggtgtattaacgctctttcaatcaccaattgaaagctttgactttctaagcctgtatcataagcgtttccgagttgaaaggagatatttttatagtctttacaattttccttcgctccttcaagaatcggttccgaaaaatcgatgcctataacagtttgaacgcccatatctgccagggctttcgaataaatccctcctccgcacccgatatctaaagcgtttgatatatgctcgacagttagcagacttttcatcatgtcaatccaggaacgatccgcaacacgggttgtataagtcaatcgattttgcttactgtgaaaatcaattcccatttcttatccctcatctctattgaaaaatcatattactctaaaaactgaacttagttttttacattaagaccaagtcatccattttacatcctaattgcttttgcaaccggtaacaaaatagcaatgtttcgctcattctctccagctttattttattatacctcattggaaagaaaaattcggaaaattttattacaaatcataaatattcattatagtcccggtaataagccggctattggagatttttgattttgaataaaaaatcgccctgattttggaaaggtgattttcacaaaatcagggctttgtatcgttgctgtttacacatctaaaaccaaatgcgccacgcactccacatgcaccgtatgcgggaacaagtccaccggctggacggcagtcagtttgtagccaaacggttcgagttcttttatatccgttgcaaatgtgtccgggttgcaggagacatagacaatgcgcgcaggttgggcccggccgattttgcgcatcactttgccgccggcgccggaacgtgggggatcgaggagcagcagttccgggttgccgaagctttccagcacttcatctatccctttgcgtgcatctttggcaaggaaatatgtgcttgaaatgccattgtcttttgcattccgttttgccgattcgatcgaggattcaacaatttcaatgccggcaagttccttgacacggtccgcaaacggcagcgaaaatgtgccgacgccgcagaacaggtcaatcattttttctgttttctccggccgacccatttcaagcgcaagatcgacgagtttctgtgcctgtactgggttggtttggaaaaatgtatcgaaccatatccggtaacggtaaccgcccatttcatcgtaaataaaatcacgtccagagaggacatgtgttttttccgcctgtgtccggtctgcccaatcggtattttcgagccagagcaggctttttacttgcgggaatttgccggtgatccgctctgccaaatcgcgggccgcttcagctagttccccatccggcgcttcggttgcaaacagggcgagcatcatttcccctgttgcaaaagactggcgcaccattaagtggcgtaagaggccttcgtgcgcatctttgtcatagccttttaagccatgctcttttacccacgcggccacttccatcgcgccatccaccatttcttttccggcaatcaggcacgtttcaagcggaatcactttccggaaattcccttgctcatgcaggccgagcgatccatccggagcaaatgtaaattccattttattgcggtaatgccaaggattatccatgccgatcgtatcacggacaagcgccgggtcaaagccttgtgcggcaatggcttcttttacatggacggttttttgttttaactgcccttcgtatgcccactgctgccagacacagccaccgcaacggtcaaagtgcgggcacatgggcaccaccctttccggatgggctttcagaatttcatccggaagtgcctttcttcttcttttttccggctgatccacggtgacgcgtactttttccccgggaagcgtacgcggaatggtcagttttaattttttcgcgttaccaagttcattttcacgccagacaaccgcctgcccggaaccttttgcatcaaggccgcggatttctgtcaccaatgattccccttgcaaaatggccaatccaatctctccttccattgaaaaacaaatatcttgaacacgtttaaagtgtaaaattttcgattcaaaaaaacgggcgtttcactgccttgtaatagtataatggaaaaaaagcggtttgcaaatgctgcatcgcaccgttgtaagccatcccgtaaataaagcttgctgggcgaatccgattttctacccaattgatcagcaaatgctgtctcaatatatagaagaaactatctgcaaaatgcaggattctgtcttctagtacgatgaaacagctcgagcgcaaacttttctctagatttttataaaccaaatctataaattttgcttattcagcaacccataagcaaaacaaagcccgtgaatctagagttatccacgggccttgttttgctttctgatttccagtatttttggcagtttgatcgccagatgttcacgacattttcgctgtttttcatatatatagtctgttgccttttcaatggaaacaagcttgttgatttcatcttcctctatatcgaaatcaaattcatccgataactccacagctaactctgaaagatcgatccagtccgcaccgagatcatcgacaaaaagggtgtcgtcctttatttccgaagggtcatcatcgaaatcattcaacacaatgtcgcgcactctttcccggatattttcttttgaaatggtttcccgcatcatcatcagctccattgtgtaaatgttaacaaattgtttctcatctacttttaataatagtcattttacaacgccagcacaagaatgcaatacctgacgctaacttttttatgccaaatttttccggggaagggccgctgcagcattccctggatacgaacccgcccggacagcttctctacaaatcaagtgacaaggacggatgcaaacactaaaatgatagtaaagtgtaaacggattctttcggtaaagcagatgcaccattcctttacccaaaagaattttctctaaccgtattatcatattgaacaaaactggggatgcctcggccattccaactgatgcggcaaaactgaaaatggcctctgcacttacgaaacgaggaggaagatggatgatttcttttgatgaacaaacgaaaactttccatttgcaaaataatgaagtgagttaccttttacaagtggatgcattcggctacgttgaacatctgtattggggaaagccggtgagggcctatcacggaggtcgcgcctatccgcgcattgaccgcagtttttccccgaacccgcccggtgcaaaagaccgcaaattttctcttgatacggtactgcaggaattcccgggttacggcaacggcgatttccgtgaaccggcacatgttatccggcatgcggacgggtcaacggtcacggacttccgctaccgggcgaatgacattttaaagggcaagccggcgcttcccgggcttcccgctacttttgccaatccaaatgaagccgaaacgttgaaaatcatgttggaagacaagcttacaggccttcaattaacgcttttatataccatctttcgcgactttccggcgatttcccgcgcggctgtgctgacaaacggcggaaacaaacctgttcggattgaacgcttgatgagcctgaatgtcgatttcccagccggaaattttgagcttttgcatctccccggcgcccataaacgcgaacggcaaatagcaagagaaaccgtaacggacggcgtcaagcggatagacagcaagcgcggcgccagcagccatcaggaaaatccgtttttggcgcttgtccggcctgaaacaacggaattccaaggtgaagcatatgcagtgaacctcgtttacagcggcaattttgccggaatggtgcagcaggaccagttcggccaggtacgctttggaatcgggctgaatgatttcgggttcagctggacgctggagccgggtgacactttttattcccctgaagcggtgatggtatacagcagagacgggctaaacgggatgtcgcaaacgtttcacacgctctaccgccgccaccttttgcgcggcaagcataaagatgcggaacgcccggtattgatcaacaactgggaagcgacctatttccgatttcatgatgaaaagctgcttgaactcgccgacgaggcacaaaagctcggcattgagctgtttgtgctggatgacggctggttcggccaccgggacaatgaccgcagttctttaggggactggtatgaatacgcgggaaaaatccggatggggctcaaaaacctggcggaagaaattcataaacgtgggatgcaattcgggctctggtttgaaccggaaatggtttcgcgggacagcgaccttttccgtgaacatccggactgggcactgcaaattccgggccgcgggctttctgaagggcgctcccaatatgtgctcgattttagccgcagggatgtgcgcaaaaacattttccggcagatgacagaaattctggatcatgtccatgtcgattacatcaaatgggatatgaaccgccatatgacagaagtccattccgccctgctggagccggaaaaccagggagaaactgcccaccgctatatgcttgggctgtatgactttttagaaaagttgacatcgcgttaccctgatattttgtttgaaagctgttccggcggcggcgggcgttttgatccgggcatgctgtattatatgccacaaacgtggacgagcgataataccgatgcggccgaccgtctgaaaatccagtacggcacaagcctcgcctatccgccgattacgatgggcgcgcatgtctcggccgttccgaaccaccaaaccggccgggttacgccgttatcgacgcgcggtgacgtggcaatgggcggcaatttcggctatgagttggatttgacaaaatgcacggaagatgaaaaagcggtgatccgggaccagattgcattttacaaggcacaccggcaattgttccagtttggccggttttaccgcctgataagcccgtttgaaggcaacagcgccgcctggcaatttgtctcaccggaccgcaaccataccattgcctattttttcaacgtactgtctgaagcagccggcccgttgaaaatattaaaactggcaggccttgacccggacaaaaactaccggcatattgaaacagacaaaatctacggtggcgacgaactgatgaacatcgggctgtatttgccattgtttaacaaacaggactttgcaagttacaagatggagtttaaggtggtatacgagtaaaaacaccgcccctcttccccggcagaggacactgaaaaacggtgagacactatgaatggcgcggtgtcttgccgttttctcttggactttttcagcggcttttctcctctcctctattcatttttgttatgaatgaatataacaattttttattttcatttttttctctatttcagtatagtatacataaaaccagtcttaaagaaagagggttcaactatggatgcatttgtagacgcattccgttctattcctaccacatgtatatcagatgctatggatggcttgaataacttgcacccgcggattaagccattgaaatcttcctattttctctgcggcaaagcttttactgttaaaatgccggtgggtgacaatttagccgtcctaaaagccatcagacatgcacaacctggcgatgtgcttgtcgtggatgcaaaaggagacgagtacagagccattgctggcgactttgtggtcgggatggcaaaaactttaggcataagcgggattgttgtggacggcgtcattcgtgatatagatggcgttaaaaaactgaactatcctgttttttgcagaggcacaactgtggccgctagcggaaaaagcggtgttggcgaaataaacgtccccatttcctgcgggggagtagccgtacatcccggggacatcatcgtgggcgatgcggacggagttgttgtggtcccggcagaaaaaggagaaaagatattgcaaaaagcacaggaaaaaataaaaaaagaccagcttagggaagaatccgtctccgaaaacaaagaagagatcatcaagtacttagactccatgatctcaaaatcataagctgcctgtctctagcactattggggttgttgaaccagaggagatgctccctgccggaaaaaagcagccgccatacaaatggatgcatggctttgaaattaaattcactttattctataaaacagggaaacattgttgttttgctgtctgctacaaacaccatgcaaatggatgcgcggctttgaaattaagttcagtttcttcgataaaccagacgaaacattgttgttttgccaccggctgcaaacaccatgcagatggataagtcgctttaaagttaagttcaccttcttcgttaaaccgagcgaatcattgttgttttgctgtctgctacaaacacatgaaaatggatgcgtagttttgaagttaagttcaccttcttcgataaaccgagcgaatcattgttgttttgctaccggccgcaaacaccatgaaaattgttgacttacccccgatgcaaaagcttaagtctgttttacacgacatacggcggactggccaaatgcttcatagttgatattcatttgccagtttcctgaacgctgcaagcgaccgtttcactttctctgtcgggatgcagtaggcaatccggaagtagcccggaacgccaaacgtatcagaaggaacgagcagcaggtcatattcaagtgcttttttgcaaaatgccacagcatcctcttccaaggctttcggaaacatgtagaatgtaccacctggctttgtgatggaaaaacccatatcggtcaaggcatcgtacaaaatattcatgttggtttcatagactgaaagatccgccgtgatgtccagcacttcggcaacagcgagctggatgattgacggcgggcagttgtggccgatgccgcgtgagatctggccgcacatattgacaatcaattccgcatccgggcagtccgggttcacagccacgtacccgatccgctcgcctggcagcgacagcgacttgctgaaagagtagcatgtaatcgtgtacggatgatattttgcaacgcacggggcctctacacccttgaacacaatttccctgtacggttcatctgtaatgatataaatctcatgcccgaattcccgctctttttcttgcaaaatctgcgccaattcccggatcgtagcttcagaatagacagcgcctgaaggattgtttggcgtgttgattaaaacggctgccgttttgggcgaaatcatccggcggaacgcgtcaaaatgaatctgaaaattttccgtatcagcaggaacaacttttaacaccgcgcccgtttgattgacgtatggcacgtattccggaaaatacggcgcaaacgtgagcacttcatctcccggtacggttaccgcccttaacgcgtgtgcaatggcgccggctgcccccgtagccataaaaatatgttctttccggtacggcatgccaaaccgctgttttaaggaatctgcaattttttcacggactgaatcaatcccaaggctcgggctgtagccgtgcaccgccgggtttttcgcaagttccataagtttttcggtaaaagcttgcgggaccggcacgctcggattgccaaggctatagtcaaaaacattttcagacccgatttcctttgcacgtactgccccgtattcagcaatttcccggatgaccgatttctggccaagcatccttttgaattcttccgcaatcatgtttttcttcctcctgaacatcaatcctatgtatagatataactataacatattttgagcccgttatgatgaaattttctaaatttgctttcttgtttacggtgtaacagtgttatgttatattaaaaatagcaaaggagtggcgaaaatggatgaagacttaatttccaaaaaagatctgctcgaacaaaccggcatctcctatgggcaattataccggtggaaacggaaaaacctgattccggaagactggtttatccgcaaatcgacgtttaccgggcaggaaacctttttcccccgcgaacgcattttggagcggattaaaaaaatccaggcgatgaaagaaaaactttcgcttgatgcgcttgccgaaatgtttgcaccgggcggcgggaaacggatcagcaaggcagatatactgaaacggggtattgcctccgattttgtactaaatttttacatcgaacaaacgcaggcgcaagaacaggcttttccttttgaggaagtgctcgccatttttttattggaaaaacttttgcacggcggggagatttcccttgaggaaggaaaaatgctggttgggctcttgcaggatgcagaaaaatcttttgcaacggaaggcacaaacgtatggctgatccgaaagttcggcgtttccacctgctttttgacaaaaaaggcagaagatattttgtttgaccgtgaagcaaaagtgattgtcagccttgatctgatggagttatcagcagaattaaaaggaaaatggctataggaggcgggcaaaagtgggaaatcttgtcataaacggagtcgcatcctcaaacggcgggacttttgacgacgtcatcgtgaatggaaaaggaacagtgaatagtgaaatcaagtgtaaaaatttggaataaaacggaatagcggtttttaaaggaaacattgtttcacaaaatgccacgatcaatggaaccgcaacctttcacggcagtctctccagtaaaagcatggaggtttcgggatcggccaagtttttggatgatgtcctggcagaaaatcttcacgtatccgggaatgcaaaatttggcggcaaagtgaaaggaacggaaatcctgcttgaagggaatgtgtctgttgccggagattgtgaagccgaggaaatcaacatccacggcaccgtcaaaatggaaggcgaactgaatgccgaaaagattgaaatgaacccgttgtggcgctgttttatccgtgaaatgggtgggcagcagatcacggtgaaaaaagtcaattctatttcaagctggttgaagccgtttacgcccacaggcctcacggttgacagtattgaaggggatgatattgtgcttgaaatgacgacagcgaaagtggtgcggggcgcccgtgtaaaaatcggtccaaaatgtgaaattaatcttgtggagtacaaggatacgtttgaaaaagacagctcagcggttgtgaaagaataccggaaaatataaagaaaggcgtgcagaacatggagagaaatcctttgattgtgaatgattcgggcgcttatggcggcggattgtacggaaatgtaaaagtgaacggagaagcggaaattgtcgatgcgctcgattgtttgaacttgtcgatccgcggtacaagcaaggtaagcggcaatacaaccgccaaaacgatttcagtttttggcgaggggatatttgccggcagtgtagaggcagagaaattgaaagtttcaggcagctgccgaattgaacgggatgcggaaatcaagaccagccttgtacgcggggagatggaaatcggcggacggttcagcacggaaaaagcagagatcaaaggttcgcttgacgtcaaagaagatgtcgaagcagaggcttttattttaaaaggaaagtttctagttggcggcctgttaaatgcggaagaaattgaaattgcgttaaagtatagcaacagccgcgcgggcgaaatcggcgggaagaaaattgacgtccgcatgcaaggcgggcttcccggcatgtttggaaaaaagcggcatctattgcacgctgatatcattgaaggagatcaaatctatttggaatacactgaagccggcacggttcgcggggaaaatatcgaaatcggccccggctgcaagatcggtttagtggagtacacgggaacgctgaacatttcaaatgaggcagtggttgaaaaaacaaaaaacaggagcccattcttaaactgggagctgaatttgctcccttttttgtctcccgctgcctgatgaagacattttggacgcggatgtttcgcggcgcacaggcatttggattgggggctgggcctaagaaagcggaggaaaaagacaatcttgacttagaacccctctaattgaacaaaagctcaacgctccctgaatgttttgtctaattagaaggtccaattagacaaaagctccccgaccggcgttcgttttgtccaattggctgacctgcgggaagaagcgagaaaaaagatattccggcgttgtcaaactcgcttttgttcctcttgaaccctgcagcccaacctgtttcgccccctattccgatcgcggccactccattttttccaaataacggaagccccaacttcttggcaatcctgtttttttcttgaacggcatgcttcccaaataaaaaggcagtgcgatgaacgggtacttcatcgcactgcctttagtttggtattacaggggacccaaccatgccgcatcctgtatacattttcacattcggggggtaactccccaatgtatgaatggagttttcagccttttcccggctgccggagtgtgatgttatcaggatgcctgtcgtcggctccgtgacagatacaaatcgttgttaagatttgctgcttttaaagcttgtgccttaaaagatccgtaactgatccggctttcctttgccttaccatattcttttgcctgaaagttcattgacatttcatttgactgttcagcactttttctcatgaatgaattgctttgcggccttttccttagaaaactttccttagaaaactttcatcgtcggaaactggttccccaatggctttcattcatttactcaagtgcctggagtttccatgatgcttcaaatcactttttcggcaatcgtttatgttccggcaaaaggtttgcttttcagctgcctgaacgggcggagggcattcgccaattcctttttagtgaaccggttgtgctcaccgttctgggcttttcgaaatatacgcgtgaagacggaaccaatcgggatggttgagtctcctgcaatcccaaactgtaagggctttccttccttacacttgcagtatagcatgggcagccgaaaaaagctgtgtcgaaattgttgacgttttcacattttgaaaactaaaagcagtgcggacgatcgcactgctttccgtcgttaaaccagtttatgcgcataccatttggcacctttgaagcggttcataaaaatgagcccgcgcacaccccattcggcaatcatcgcgacccagacgccaatgatgccaaaaccgaatgtaatccctaaaatatagccgagtatgacccgcaaaagccacattgacagcagcgaagcgaccgatgtaaatgttgagtcacctgctgcccggagcacggccggcataataaaactttgcggccataacagcggctgcccaaacgcagaaatcaggacaatcgtaaagatcgtcggaataattgagtcaggcggattaaacaattgcatcatgacagggaaaaacggcaaaagaaccgctgtcgttacaacataaagtagcgaagacaaaacaataaacgactttgcaaatttccgtgcgtcatcgatattccgccgacccatgcattgtccgacaatcgtgacaatcgcaatgctaagcgcattcggtccaatctggaagagcagcgtgattgaacttgcgatcgcattttccgtcaacgccaatgtcccaagctgcacaataaatgtctgtgtcagcagtttcccgccgttaaaaaagatttgttccgccgcaaacgggatcccgataaacatcactttcttcaataaagaaaagtcgaggtgaagcgcatttttaattttaaaacgaatcgtctcattgtacttcatgacataaaaaatggaagcgatcatgccgaaaattcttgcacataaaatggatgtcacaaggccgacgacgcccatatgaaaaatggtaataaatacaacattgagcacggtattcgttaagttcataaacagcgacaagccaaggcatggctttgtttccccgacgccgcgcaaaccgcccagtactgcctggaaaatcgcaataaaaggataggagagacagctgccaatcaaataaattctcgcattatgaaaaacggctgcatctgctttcccgaacagtaaattgagtgtcggcgtgttgaacacaatcacaaacacggcaagcacgaccgaaaaaatagcaacagcagaaatggcttgtgtcgcggtctttgacaccatttctttattgccgattcctttatactgggcaacaatcaccgttccaccggttgcgatcgctataaatacgttgacaaggaaaatattcaatgaatctaccatgtttacggcactgacagcactgacgccggcagaactgatcatcgccgtatttagaaaactcattaagatcaaaaacgtctgatccaccaaaattgggataataatgccaataacttcccgataatctatagaatcccccgttaaatatctgttcaggtaaaaagtagacttctgcttgagtttgacagctttgatttccataagacctctcttcttcattttgcgggctttttcatccgttcttttgaatgcaacccatattatatcaccttgataaaaagagtaaagctttttcgcctggcgaaatttacgattttgtgaatagcaggtaacccggaaaacaagcgccagcaagccaaatgaggcctgaaaaactgtatttttccatcggtagctattcaatttttgacgcttcatttccatggtgatacgatagacatgtaaggggttacataaatggggaagggtgtatgatgatggactttcaaaatatcaccattgcagggagcggcgtactcggaagccaaattgcctatcaaacggcttttaaaggctttggtgtatacgtttatgatatttctgccgaggcaatcgaacaggcaaaagaaagaatttccgggttgaaggcccggtaccagaaagatcttggtgcaacagagcaagaagtgaatgaagcctatcatagaatttctttttctgatgatctggggcaagctgtagccaatgccgatctggtcattgaggccattccagaagtggtttccattaaaaaggatttttaccaaaagcttggaaaattagcaccggaaaaaacggtctttgccacgaactcctcgaccctgctgccaagccagtttgcagaagcaaccggccgcccggaaaaatttctggcgctccattttgccaatgaaatttggaaaaacaatacagcagaagtcatgaaacatcctggcacagatgaaaaagtgtttcaggatgtgatcgcattcgcagaggcaattggcatggtagcgctgcccttgcacaaagagcagccgggctatattctgaactcattactcgtaccgctgttggaagcagcccaaatgctactggtaaaaggggttgccgatccggaaacgattgacaaaacatggcgcattgcaacaggcgccccggctggaccattccaaattctggatgttgtcggcatcaacaccgcctacaatatcagtttggcaaaagcagaagctaccggcgatgagctgtataaaaaaattgcagacttgctgaaaacggaatacattgacaaaggtaaactcggaaaagaaacaggagaagggcttttacaaatatccttccaccgaatcctgatgtaaaagaaggacccgcacaaagcggggccttttttattttgtcttgcttttatagtgatcccgaaaaaacttaattcaaaagccacagccatagatagatagaaaagaatcaacctgtatctggtaaacattgcagcacttgctgaatgggccggatccaaagccaaaacggatttgttcgacacgccctgtttaatgcacggcaattttctgcccatggaaggccaaatattggacggcttccggcggggcgatttcctgcatcatgtcgacaaggcgctgatgatgcgtgaaaaagatgatttgcgtgcagctggaaagttcgagcaatactttcaatgtttcttttgaacgttcatcgtcaaaatgaacgaggatatcatcgacaatgaacggtagcggctcgttttcagctgcgtatttttcaatgctcgcaaggcgtaaggacagatacagctggtcggtcgtcccgtcgctcatcccgttcagcggcacattctccccgccgcgcacgcccattaaaacaggctcgtcctgctcgttgtaatccaccgccaacccgtcaaaagaatgaagtgtcagccgcgcaaaaatgtcacccgcacgatttaaaatcggattttgattttggctccggtaaaattcaatccccttttgcagcaaagcggcagcgagtttcaactggatatattgctccgtcaaactggcgatttgcgcatgcacgctttccctttcctggccggcttcaatggctgtcatgttggcgccgcgaatctgttcttcgtattcttttttgaccgccccatattcctgctccacctcggaacgcgaggcttccaaacggtcaagttcacgcccggtttccgccaaatcggcgtcaatcgaatctgcatcaaaccgggccgcctcatcaagcaattcctgcagtgatttaccggcacccgcatccagcatgtccgcttcgatttgccggatttctttttcaaaactttttttcagcaggaaagctgtttcaatttgctttagttcttcgattgtgctgcagcctgcctgttggaaaagttctgttaaaaccgcttcagctgcttccagtgcttctgtttcttcttttctctcattctccaagtcttctaaacggcgtttgagctttttcaaagcggcatcgtcctgtttggcattttgcagcagctgatacatccggtttacggcaacagcggcattctccccgttcaatggaagttgggccgtttcaaggatatgctgcactttttcttcaaagcgcgccattttttcagtaacggcttgctgctctttttcagtctggttgtatgcatcatagagttgcatacatgtttcatagcgggcgagcagggattcagcaaccgccggcggcacctcttccaatattgccgtgcccgcgacagccgaagaccaatttgccagccatgcttcgcgtttcttcccgatttccgctttctccgtttgcatctcttcccgtttttcttttaaatcgcggatagccgtttcgaggctgtccttctttgcggcaagattgcggactcgtttcaattcgttttctgcaagacttaccagttccgcaagcggctgcccttctgaaacggcggcaaatgttttcagcacggcagatagcgcattgcagcagtccgcacggctatcatggagcgcgcgcattttatcttgctccttctcataatcctgcatcaagcttttaatttgcgcgtgtttttgcagccattcccgcatctctccaggcgtaagcggacggatttgcgccggcgcccaaagattttgccagccggattcccacgcacgcaaagcttcttcaagtccggatttctctttttcaagctgttcctttttcccgcggaactttctaatatcggctaaaagtttattcttctcgccgactttttccgcttccagccgcatcgtatccgcaatctggtcagcttcaaggacatgtttctcataaaccgacgcggccggctctccctttgtatatgtttcagccgtttcaagccaatggccggtttcaagtttggtgcgtatcagctgccagccggcatcccttaaggcacggacggccgacagcttttcttcggacgggatctcggcaatggaatcaagccggcggatgctttcttctgaagcttcgatgtcctctttcaaccgggaaatccggctttgcaccgaatccagctgccgcgtcaattgctccgcttctttttcaaactttttcaccgtttcttccaaaccgggcaccggaagtttgacaagttcttccgcctcgccatcccataacggcaaagcacgaacggcttcttccacttgccgctgtttttgccggcattccgcggccagctcgtgtatcgccgcttccacgtcccctgcacggttcacctttgccaggacggcttccagtttttccacgtccggcagatcaggcaaggcagccaattcttccagcttctttgccagctctttttccagtttttcgccttcccgtttcaatgattcataagcctggtcgagcaacggcttttgcttgcaaagctcgcggatcatttctttttgggcggaaggcagccggtaaagttctatattttcaacggctgcacggcccgggtcgatctccttcataacggacatcaattgggcttggagctgctgctttttcccttcgagctcaggcaacattttttcatcgtcttcgtactgttgcacttggcggtaaagggctgtaatcgcggcagcctgttctaaaatgtgttccggaatgctgatttctttcatttccgcttcggtgcccgccagttgccgggaaattttgtccaagtttgcccgggaagcgttccatttgttttccgcttcggcacggacttcggcaatattatctggaagatccgggacatcgccgagcgcttccaatttttgcaaaaggtttttccggtttgcgatcttcggcaaaatccatttgacccgttgcagctgttctttttggctgcgcagcgtctttatttttgcggtgagggcgccgagttctttttccaactcccggtaacgcgcctcgaaagctttccatgcctgtactttcaactgctgctcattgatttttttcgaaagctctttttcccgcttgagcagcttatttaattcagggacggaaccggtttttttgtacagtgcgcctgcctgtttgtcaaagttctcgagaacccggcgcagcacattgatgcccgaagcggcggtgaaaaaactttccccggcattgcccccgctttccaaaaggctttcgccgccttcacgaagacggacatggtcaagggcaaacatatttaaaaactgggattccggcatatggtttaaaaaggccgcgaccgtattttccgggaccgggttgccgtccgggtcaagtgccgtattctttttcccttttctgcgggtaaactgcaaggcttccccttttgtgttgcgcaaaagcccttcaattcttaatttcgtattgccatggaggaaagcgtcgttcgttttttgcggaaatccgtataaaaaatgcgtaatcgagcggagtgttgtgctttttccggcttcgttcggcccgaacagcagatggaagtttttctccggatcaaaggaaagcatctggtcagtaaaatgcccgtaagcaagcaggttcaaataatcaaatctcatgccttttccgcccccgtttccgttaaggaataaagaatgaagtcttccacatcttttatccgctttttgacgaggcccgggttggaaaaatcaaacccgtcttccccttctttcagttcatgcggaatggcctggcggatatcgctgaactcatccagcagcgcttcaagcatctcttcattttcggccgtgctgcggataaattttagcaccgtcccgattggcgactgttcatcggaaaaggcatcggcatcgttcagtcctgttgttttgatttttactttctccacccagatttcaccgaaacctgtctcaagcgcaatggaacgcagctggttcaagaggaggtctttttttgcaatcagttccctgtgcattttcgttgcgccggccaattcaaaacgcaccgccaagtaacgcccgtctgcttccccgtatgccttttcaagcgcactgcgggccgcgtccatgagcccgtccatcgtttcgatgtcgcccatatcaaccgggcataatgtccagcgcaacacatcaagcgggatgggttccatcttttcaatcgtatcgtcttttacttccacataggtgcagcccttttctcctgtctcccggatatgccgtccctggatatttcccgggaacaaaatcaccggatcatgcggatggagcaattcccgcatatggatatggccgagcgcccaataatcatactgcttctccatcatatcttctatcgtgcacggcgcgtaattttcatgcccttcacgccccgtcgcgcttgtatgtaaaatgccgatattgaaatagccttcttttttcggcggatagttcttcacaagattttcttccactgcccgttgtgcaaaaccttgcccgtgaatggcgacgccaagtgcatcaagggtaaccgtttccggcgctttgaccggaaattcgtgcacattggccggcagtttcagagatttcgtcatcaaattggccgcatcatggttgccgcggatgaggaaaacaggaatgccttctttctgcaggcgcaccatctggcttgtgaaaaagaggccggtattgtaatctttccagttgccgtcatacaaatcgccggcaatgatgagaaaatggacttgccgttcaatcgccgcatccaccaaatttttaaatgcttcacgggttgcaccgcggattttttccactggtgctccctcgtattgctccaggccggccaaagggctgtccaaatgaatatcagccgcatggataaatgaaaaagacaaggcactccctcccgaatttaaaaacgagaacatttatttgctattttcattttacatggacagggagggaatgatcaagagaaaaaccgtttttctgaaaaatttttatatttcggtaggtttttttgcaagtcgttgtagtttaaacagaggagttacgcccggccgattcccagtttatattgaatatcgttcaccagtttttggtatcttttttcttcccggagagctgcaaaaacgggattttcctttactctcctaccacctgcatcagaaaagggcggacagttttagctgtccgcccttttctgaatcgtccggtacgtgcgcggctttaatcacgggagatgtacgctgcttcttttgcttcttttgcttcttttatttttgcatacgtttccgtaagcatgacggtgtcctccacaagccggctgatgcgcaagaggacgtcttcattgacaatttctttctggtaaaaatctttttcctctataaaaacataagactggacaatttgtgcccgcatgtaagacaaaatcggcttgatctgctgctcggcaatcaaataatgtttcggtgagccggccgtgacaatgatgcttgccaccttatcccgaagtgatttttcgggcagcaggtcaaacacatttttcaatgtcgccggaatcgatgcctggaaaaccggcgtgccgatgataagcgcatccgcgtccatgacagtttgcgccacaaatttggtatccccttcgtaatccatataatggcgcccgtcgctgaactgcacatcgtaatccgccagatcaaggagcgtgacttccgcgtttggatatttcccacggatcacgtttaccgcgtagttcatcgctgttcttgttttcgagccgactcgcgagcccgaaagtgcaacaatcttcatttatgctccccctggttctttgctgtatatttttcaatgccggtaaaaagtccgccgatttctctattttttcaaacagcctgtgccggccgggattgacagactgccggcgttattgctgttataccttttctgtaaactgctgctttgttcttttgtaactattataatatgaaaaaagaacggttgcacttaatcgcgcttcggaatcggctccggtacatttcaaaaggctgtccaaatgaacagcctttttctttccgtttatttttctgtctctttcaactgatcgagatattgcatgtcttcactggaaatttcaaagtctacgtccgcattttgcaggataaatgcctcatgcgtcgattttgggagtggcagcacgcctttttgcaagcagtaacggatgcaaacttgcggaagtgttttgccgtatttgtctgcaattttttgtatctcggtgttttccagaatttttccagtagcaagcggcgaataggcctcaaccagaatgccattgtcctggcagaatgctgtcacatcttcctgtgtatgtccaatgaagtaacggatttgattgaccatcggcttgatttttgcattttccatcacggctttcaggtcggaaacgctgaaattggaaacgccaattgcccggcagcgcccgctttcatagatctcctccatcgctttccaaacttcaatattttctttcgtgtaatcggcccccttttcgctccacggccacggggcatgaatcagataaaggtcgagctgctcaaggccaagattttccattgtttcgtcaaatgttttcagcgctttgtcatacgacttgatttccgccggcagcttggacgtgacaaaaatgtcgcgccggtcaatgccggaatcccgcactgctttgccgacactttcttcattatggtaagcataggcggtatcaatgtggcgatagccgttttttaaagcaaaagatacggcatggtaagtggtttcgccattcgggacttgccatgtaccaaggccgattttcgggatcgccaccccattttccaatacaaaagtttcatgtagacttgacatatacattcctcccaattttacaaaaatggtttatactacagcaccggccgtttcggttgcagcctatgtgaagaaactacgatttttttgcgtgctttctttacataaacgcgctctatgttaaggaacatcaatttttttgcgcgtttccttcacgtaggcgcactctatgttaagaaacggcgattttcttgcaccctttcttaacataggcggcttctacgttaaggaacaacaccttttttcctcgcttccttcacgtagacgcactctacgtgaaggaacatcgatttttgcgccagctttctttacatagacggactctgcgcgcgtggtaaagcaccaaaaacatgaaaattctgattttcttgaacccttttctgagccatcaagaaccgttttcccggaccgtcaaattcccctcaattaagcattagccggaaactggccgagcactttatgaagccaggaaacgcttaggccaaaccatttttcaacatctgcatccacatttgcttttaatccgtttgaagtgtggggtttggcgagcgacagcccgtgcttgcctttttgaaaaatatgcgactcgaatggaatgccgtgcacattcaacgcctgcaagaaggcaatcgagttttcaatcggcacggtttggtcttcaaaagttgaaaacagaaagaccggcggcgtttcggcagtcacttccttgtcaacagacggcaccggaaaagcaaggctttcgctcatcgaatccaaaatacatgggtagcctaaaatcaaggcattaggcttattttttccgatcgtaccaagtgcagcggcaagatgccctcctgcagaaaaaccggcaaccgcaattttttcagggtcggtatgccagtcttccgcatgcgcgcggatcatcgcaatcgcttcttccgcatcttgtaaagccgcttcaaaccggaatgtttccccgaccgagtagcgaagtacaaacgcgttgaatccttccgccaaatatgccatcgcaaccggttcagcttccctgtccgaagtaaaccggtaggcgccaccgggaaaaataagcacaaccgggcgcgcctcgatattgctgaactcgggggatccgtccagtacgtacgccgtcagttcagcattctgatgcgcctttaaatgtaaagtttctgtcttcacaacgctctcctccttctgcccatttccgggacggctttatttttacagtagcaccggaaattacaaaaaacaatgaaaacgttcctgtatatcctgccccgtttaaaacaaaataagattggtttaaaaaatgaagtggaggttgaatcatgaaattagccgcacatgaactgtacgatttaaatgaactggcgatgagctgtgtcaactcgattacgaacatggcttatatgctccagcatgtccaggatccggcattcaaaaaaattcttgaaaagcattttccgctccatatccgggactataacatgaaagtcgaatttttaaacaaagctgaaggggcaaaaaaagaattgccgttgttaaaagaaaatcaagagatctccaatatggcactgcaaatggccccaccggctgtcccgtccagccgcggacgatggttgaagatatgaacgaccgtgaaatggcaactgcgtatctgttaacgctgaaacgggccgggcgggaatatgcatgggcggcgatggaaatggcaaatcctgaaatccggtcgttttgccagactgcctttatgatgagctgcgcccacgcctatgacatgtggcagtatatggcatcaaaaggctactatccggttgaccaggcagaatctgtggatacggcaaaaatcggcgccatgtaccaagttgttccggaaaaccagccgcaaatccagcagtacatggcacagtcccagaacccaactgccggagacagcgggcaattgtatcaataatggcttcattccggtgagcccggggtatcagtgagtagcctattgcagaagcagctgcttctgcaataggcttatttgtctatcgtttaaaaccaacttacataacaaaaagaagagaaaggcatttgattttatctctaagtcaattccttgaactcctccccttttgccgcccataatgtatttgtggagcttatgtccaattggaacacctaacgggacagttcttccgcggcggcaggggcttttgtccaattagaaccgctaacggggcaatcctctcaaaaaaattatgacaaaaggcggcgaatttgatgaaaatggtacaaatgcaaaatgacaaaattcctccgattgcgcttgggacctggtcatggggcaccggcgcaaacggcggggataccgtatttggtaatcaccttacagcagctgatctgaaaccggtgtttgatgcagcaatggatgctgggctgaacttatgggatacagctgctgtatacggaatgggcgcttccgaaacgattctgggtcgttttatccgtgagcgcggggacgccctgatctccacaaaatttacccctggcggcgaacaggacgacaatgcggtggaagcgtttctggaaggcagccttgagcgacttggtgtggatcatgttgatctttactggatccacaacccgggcgatgtaaaaagatggaccccgaagctgattccactgatgaaaagcggaaaaataaagcatgtcggcgtttccaatcacaatctggaggaaatcaagctggctgccgatattttagcagcggaagggctgaaactttctgccgtgcaaaaccattacagcctgctgtaccgctcttcagaagaagccgggattctagattactgcaatcaaaacggcattctgttcttcccttatatggtactcgaacagggggcgttaactggaaaatacggaccgcaaaacccattccctgccggcacgaggcgaggcgatgcatttactccggatgtgcttagcaaactggaagatttaatccgggtgatgaaaaaaatcggcagcaaatacgaaacaggcccggcacaaatcacaatcgcatgggccattgcgaagggaacggtgccgattatcggcgtaacaaaggtttcgcaaattgaagacgccgtttcggccgctgaagtccatttgacagaacaggaaatccgcgaactggaagcggcggcaaaagcaaccggtgtggaaattaagggcgcctgggaaaaaccgatgcactaaagcaacaggggctgatatatcagcccctgtttttcatcaaaaacgaagggaatggctgatttgttatcttcactgaaactgatcgcaaaagcaaaagcgggaaatacggatattctccacgaacataaatggctttcatacttgtaccgtacagacgaaaaaaatgtgaacctcgaacaagtcgaatcattggaaaaccttgaaccgaatccggtcctgcactatgttgaaaaaacgctagccatattggaccgctgttatgcagacttgcccgcatctgaaaaagaaatcattgaggaagttttaagatggagcgaggtggcaaaatgcgggtctgcccaaaagcgggaagaatggcgcaggcgcggttttcaattgcgtatccataatatcggatcagcgcggatttatgcccatgaacaaatggcggttccattcgggcagcgtcatttgcaaaaagaagacctgatctatacgctcatcctgacccacggccttgtcgggcagtttatcaggggagaagtccgctaccgccagctgtatcctctaattgattggatccaaagccaccggtcatctttaaaatgggatatcaaacgcattttgcttgccctcaatcactgtattattgaaggggtatcccccgctatatgggaaaaagtccgtgcagaaacttcacaaatcataagctggattgccgcgggagaaaaaagccgggagcattcccttaaagaacggctcaggcgattaagagaaagttccatccaaaaaggcgaggactttgaggctttatacacaaaatggttcagcaaccgggaacttgccagtatgtttcacttacttttccagaaaacggatatttggtatgtggaatccgcactgcaggatttttcttttgaggaattcctgaaaatttttcttctcgtctatcagaaaacaaacccgcttaccgttgagcaaatcagttttgagccgttgatgaaagatatctattatgattacaaagggaaaaaatcggttaatttgtataaaaaaagaattatagaagcatatttaaaagcttgtccgctagcaggcctgatcagcggagatacgcagccgaacgaacatgttacgcttgaactcattccgttcgattcattgggcagtgcaaccggcgtcaattttactttttccaaacccggggaaaagctcatcgcattttgccaggaagcagaaaagtcccctctctatgaacgttccatactcttgttgtacgattttttcggattccgtaaagatgcgtttgacaggctgcaaaatgaacagcattatttggcagacatgaacaatgccgaagaccataaaaagatcatcgcagactttgcaaaaggaacggtcatgattgatgttggcgcagggggcgggatcatgctcgatctcctgtccgaaaagcacccggatgccgacattacggggatcgatatttcgaccaatgtcattcaagaactggagagaaaaaaggtccgtgaacggaaaagctggaaggtgaaacaggcagatgcgctcaaactttcatcttattttgagttagagagcgctgatacaattatattttcatctattttgcatgaaatgtattcctatatcccttttcacggccggacatataacccggatgtcgtaaaagcggctttaaaaagcgcctttgccgtgctgaaaccgggtggcgcatgatcatccgcgacggcattatgacggagccaaaagacctgatccggttattagcattccgcgatccggacggcttccgctttttcactagatatgttgaagattttaaaggcagaaaaattgattacgagattacagaggataataagatcaaactcccggtaaatgacctgatggaatttctatatacttatacatggggggaggaagcttatccgcatgaagtccaggaacaattcggatacttcaccccatctgaatatcggaaagtgattgaagaaacgctcggcagcagggcaaacatcatttgtttccgccactatcttcaagaaggctacagcacgcacctgcttccgaaagtcaaagtaatggacgagagcggaaaagaaaccgcactcccggacagcacctgtttcattgtcattgaaaaggcggaataagccttcatccgggctgctccgcgagaagaggctgtttcaagcagcctctttgcatccttctgttttttacctaacctattccattttaccgataaaacatactttacaactaggattaattggtttaaaattatgttaacattttaaattcactgaccgtataaatgttaggaaggagctcttttatgcatgaatactatcccgttctttcgggtgcagaatccttttttataaaaggaaatgaaattggcattctcatctcgcatggcttcaacggcaccccgcagagcgtccgctttttgggagaggcactggtatcggacgggtttacggttttcgcgccaagattaaagggacacgggacgcatatcctggacatggaacgctgcacttacaaagactggattgctagccttgaagaaggttatcagctgctgaaacagcattgccgcgatatttttgttattggccagtcaatgggtggcacactggctttgcatctcgcggaaaaacacccggatatccagggaatagtgtgtatcaacgcggctatccaaagcattcctgaactggaaaaatgcctggcgaaaggacggtttattcaagagggcccgccggatattaaagcagcgggcgtgcatgaaatttcatatgaaaaagtgccggtggcttccatccgtgagcttctgtccgtgatgtgggaaacgcgggaaaacctctccgccatccattgccccgcacttttgttccaatcaacagaagaccatgtcgtgcctcctgaaaatacagagtatattgccgcgcatattcatgccagccggaaaaaaatcgtaccgctccgcaactcttatcatgtcgcaacaatggatcatgaaaaagaatggattgcggcccaatgttcattatttgttcaagaaattgcgcatatcgaaacccgtacggaaatatgatgagttttaaatcatgctccaaaagaatgggaggatgctcatttgaaaaattttctacggcacgcgatagagaaaaaacggcaatatttgatagaacagctgattgctcttggcgcctatcaggaagatgacaagcagcttttcaccctgacattgacggaacttgaaacagaatatgcatacttcagcaaaatcagccaagaaaaagaagcgtccggaagagaatagttttgccggcgcttcttttttgtgtatttttttaaatgcccaaaaacggcatagacgttcctgccacagtaaacgtgacacctttatttagggcttgctgaacgaatccaattctgagtttgtctgcaagctctgtctcaaaatatagcagaattcttttgcagaaatgggtgattttatctgatttggcttacgagtgcaagcttttcaccggatttgttgtaaaactagcatttaaatggttgccaaagctgtcagcatccttgccaaatctaagcagtttgcttattcagctagctctgtacaggttataacagccctacaatttgcagaccgtggggaatgcccatgtcttccaccgattttgtaatgtatttggcggcagcctttaccttttcttccgcatttcccattgccacactgtttttaatcatggacagcattttaatatcatttaacccgtcgccaaatgcatattggcgttctggaggaaagcccaatttttcaacaatcttttcaattcctctcgcttttgacccgccttttggcaaaacatcgacggaaagcggatgccagcgaataaattcaaaatccggaaacgcctgttcatactgtttctcttccccttctgaacagaacaggagcgcctggtacaattcacgccctttataataatgcgggtcatacgcaggcaaccggccaattttcaaagacgtaatgcttttttcaatatcctcgtggtttggcacattggccttcatgtcttcatggtccatgtagacaagcggatgctggtgggaaagggcatatgcagtcaattcttcaagcgattgcctgtttaacggatttttaaacaatacctctccgttcataacaacatattgcccgttataacttacaaaagtatccatcccgagttccttccgcaaatcttcaaacataaacggggccctgcccgttgcaatggctgtgacatggccatcgcttttcagcttatctatcgcttttttggttgtgacaggcagcttcttctcatgtgtcagcaaagtcccgtcgatatcaaaaaaaatcacgctttgttgcttcatattcttcataatcctttcccgttctatttcaagcatactcattttcaggatgccgttttttcattaaagatgctgtaatgacatcataaatcaaaaaactcagcagttcaaataaggttccgattctatccggggtgaggccggcctgttttatgctttcaaattcagacgattcgtccggcaacaagaccgtcacatccgccatttttgcaagggttgatgcgggagaagccgtgatggccacaatgtttataccgtggagcttggcttttcgggcggcattcaataaaacgggattttctcctgattttgagctgaacaagatggtatccccttttttaggaacaggggaaattaagtcgccaatcatcccaacccggaaccccaaatggaccagcctgttggcaaagacacggaggatcatttccgaacagcccgttcctgccaaaaacaaacgattcgaccgaccaatcacctctacaacctgctctaatggttgatcgtctactttactgcacaaactggcatacagttctaaaaccatggcctttgcatcttccagtatattcacttttctccctccccgtttgataaagcacaagcatcccttttgcggcactgctgcagacgccgtttttgttttggcaggctgaggttggccgggctttacacgcggcaggacgaaacttcccagcctatatccctataccgtacctctttcaatgagtgttgctgagatttccttgtttttaatttcctttgtcaaaacctggtggacaaggttccggcccatttcaacaagcggaatatctatcgttgtaatattcagcattccggcaatcggttcattgtcaaatccgatgatcgccaactcatccggaatagaaatttgctgtttgttgcaactgatgacaatccccgctgcaacctggtcgcttgttacaagcaatgccgaaggaggcgggtccatttcttttacccggctcaaaaccctttctccatcctcatagtcgtagcattggtcaaaaatatattccggatggtgcggcaaatggtatttttcatggaaatcccaataggctttatcgcgattccggctgttggtgccggatttcctgccgatgcaatacccgattttcgtatggcctttccggtacaaaaattccagtgcatccataaaaattttatagtggtcaatataggttgacgatatttcgccgccttttacacattcacaaagcgcaatcggcccgaatggcaagtattcttcaattttgcgcatactgcaggcgcgcgaacaaatgattaaaccgtcaatttgcttttgttgcagcatttgtaaggcttccgtttccctgctttccatatagtctgtttgaaacaaaagcagtttatggttatactccagcgcctgctttgcgatccctttcaataaaagggcaaaataaggatgatctgtaaatggcaacacgaccccgatcaattttgttttccctttacttaaatggacggcattgatgtttttatgataccgggtcgctttcaccgcttttaaaacagcgttctttttttcttcactcacatacggatgattgttcagcacacgggagacggtcgtcacagacacgccggccattttcgccaagtctctaatatttgtcataacctcacctattaaaacacttgcgatttttcagcaggcatccatgctttaggatggaagtgtttaaaccaagcccctgccagcaggctcatttttatgtatttatagtgtaaatgatgaaacgcatttcatgtcaatttttatttttgcaaaatccgtttcgatgttgaaacagaaaagcgccggtgaagatgtggacatgcaaaaaagggctggttgctgcagccctcccgttttaccggggaaaaggggaccggcatcccggccggccccttgatctgttcaaaaacccccgtacatgcggtttcatcttctctgctccagttccttcatcatcttcttgtatctgttttctgtaatcggataaaagctgatcagcaaaacagacagcaggatgaaaatgccagggatgatggcattcatgtccttaatcgcttgaagggatgaaacggactgggctacatttggaacatagccggccttgtttaaaaagaacgctgaaaacgaaccggcgagcgcaacacccagtttattggtaaaactcatactcgaaatcaccacaccgtctgcgcggattcccgttttccactctgcatagtccacacaatccgcaagcatcccccatgcgagcgtgttcagcggggtggtaaaaaacccggaaacaaacagtaaaaacaaaatcagtggaatggaggaatatgctgtaaattgcaagccgacataagaaatcagggaaagggctgccgaaatcatcatgacgttcttcctgtcccattttttggacaggctggggatgaagatattgctgatcagcgcagcaccaaaaaataacagcgtccccataaacaccaaatctttgcggtggacattataggtgaagtagtaaaccattgtcgtcaatttaatgttaaaaccgacggcaaaagccaggaaagaagaagccaggatgagcaaaggtttatttcggatcaagacggccaatgttttctttacaccgtgtttttttctggttttatagcgaccctctcccgcactgtcaggaaactgatcaaatttaatgcaaagcttgcggccgcataaacaagcgccgtgagttgaaatccttttgcctggtcatcgccgccgaaatattgggcaagcggtgttgcacaagatatggagagaagaattccgatatagaccaaaatcatcctgatcgttgtcaataatgtccgttcctgtaaattgtccgtcattcttgcagtcaggctgtttaccggtatcgtctgcatgctgaatgacatcccgagcaaaatataggtcacgtatgcataaattctgttgcccgccacactaaaatggggcgttgtaaaacataaaaaagtaaacaaagcaagaggaactgccgcccataataagtacggccgggctttcccccatctgctctttgtcttatccataatgacgcccatcaccgggtcaaaaacggcatccaaaacgcgcacaacaaggaacaaagtgccaatgatagcaggtgaaatcccgtccacatcggtataatagaataacagataggcgtttacgaactggaaaataatattataagacatatccccgagcccgtaaccgattcgttccgtccaagacaacctgccgccggaagcgctcttttgattttccgctgcatggaatcgtactgttttatcagaaaccaacataggtgatacctccgaatgcgttttcaatgattcgttcattcaactgcctgcagaaaaacagacattttgtaccggcttttccttcaaacatgcaaatggatgatggatgcgggtggcttgaaattcatcggccagcccgcatcatcctccccattctatgattcgtgtgacatcctacaggccatcatgatttcgatcctatttttccggtgaaacccatccggcccgcgcatgtagattgcaaccattttctataaaatgaacgaatgatactacccttttcctaaatagggatgcctcgctcttgttataaatgaacggctcagtattttcagttgttcggataaaccatgactttcaggcattcgttcttgaaattcagtgcgcgttccatcgcctgataagtatcttccaaggcatattgatccgtcaccagttttttcacatccgcgatgccggaagccaaaaattttatgccttttggatacgtattcgcataacggaaaacaccgtaaatatcaatttcattatccgcgataaatgggacgttcaacggaatttcattttgagccggtaaaccgacaatggccagcttcccgccgcggcgtacagatgcaagcgctgattggagcgctgctggattacctgctgtttcccaagcaacatcaacccccttgccattggtgatgtcttgaattgcttcataaggatcttgttcgcgaatattgatcgcataggtagcgcccatttcttttgccgcttcaagccgcaatggttccaagtccgttacaataatgttcgacgctccgaaggccctcgctgccacaacagccattaaaccgaccggacccattcccataatcgctacggtcgatcccggttgcagttttgttcttgtggctgcgtgaatgccaacggaaaaaggttcaacaagagaagcctcttcataagaaagcgcatccggaatggcgaacacaaagtcttctcgcattttaatatattggcaaaaggcaccatctacaggaggggttgccaaaaattggacatgtgggcaaagattgtaacgcccttctttacatgcttcacaatgcccgcaagtgacacctggctcaacagcgactctgtcccctactttaaaatggcggacttttgaaccaactgctgcaatttcccctgcacattcatgcccgagaataaacggcttgtccactacatattttccaattctgcccgtttcgtaataatgtaaatccgaaccacaaatgccgaccgccatgactttaattaaaacttcattttcttcaatttgcggaacaggcaatgtctcaatcgaaatatttcgtgtcccgtgcatcactgctgctttcattgtttcaggtatatggtttgtcatcttcaaagtccctctctttgaaaaactggatttccggaatataccgtgatgaaagcgcattcattttggcatattctgttttcactatttttatcatacaaaacggatgaaaggggaaccagctattgttgctgtataaaaggacagccgcactgtatgttttatgcttaaattttagacttcggttattatattgataaaatataggaaaggaggtgaggtccttggccgaacttgaaaaccaaaaaaagttttccagtctgctatcttccggtgttaaagctttaaaacagcacccggattacaagacaaatagagaagccggcaacaaaaccgggcaatcttacatggaaaaaatcgcatacaaactaggtgtatcccctaacaccgttaaaagctggatcggccaaatgggatcgaagtatattccgggccggatcgaggatgccaaactgttcggcatcatctggctcattcttgaaaaaggatgcatgaatgtaacgtggttcatggaattgctggaaaccacttccatccctgtcatcgaaccggcattgccggcatgggtggcgtcctgccttaaaaaagcaaaaacgatgaacgataacgggacaatcggtacacccccgcctgaggaaatcaatatggtcatcacccgtctgtttggaaacgccgctgtgcttgaaagcgaagagaaaaacaaattttccgcgcacaacctgcccgcacgctggtcagggcgctttattggtagaaaatcagatttacaagccatctatcactggcttctttccccttcgcctgtttgttccattacagggtgggccggcgtgggaaaaacgacgctcgcccttgaagccgcttatgcttgtgcaggggaaccgggtgaagaagcggcaaatgtctctgataagtggcccgcgtttcactgcatcatttggttcagcacccatttaacagggttaagtttcaatgattttttaaatacaatcgcttaccagcttggactgacagaacaaatcgataaacccgtcatggaaaaacgttttgcagtgcggcatgctttacagcttttttccagggaacagccgatactgcttattgtggatagtatggacgccgctgaaaaagaggtgcttgaattcattatcaacctccctcaaggcgtaaaagcgatgctgacttcccgtgaaaactacaatcaagattataaagacgcttttcaaaatttcacaattgtcaagttaaagggattaaacgaaaaagaggcactttcatatttgtcatttgtcatccgcgaacatttgcaaaccggcagtgcacctaaccaggaagagttgcggcatctgacaccggagatgcaggcaaagctgatcaaagcggccgccgggaatccaaaagcgctgtccctctgtattgcctatatcagcgacggcggcattccggcagaacaactcattcaggaaatcgaaagcgccgggtattcattactggagttatttgaatttcttttcgggagaacatggaagcgcatcgatgaagcagcccgccgtttatggcaggtgctctgtttttttgaaaagccgcccgttgaagctgcctgggccgcagcggcaggattagatgccaggggcttttatgcagcagttgaacaaatgcggaattatgcgctgatccatcctgaccggacagacggaaaattgcgctaccccgcgcatcaaaccgtgattgcttacggtgaacagcacttgtcggaaaaccggcagctggaaaaagaggcgcgaaaacgatgggctcgctattatatccattttttggatacccatttaaaacgggaacagcccaatatattctattggcgctatctgcttggccgggatctcgatgatctgaagcaggaatggacgaacattcgcaaggtaatggaatgggccagccaatcagacgaaaaggaaatattgattgaattcgtagttcgtaccagccatttcttaagcagggtcaatctgcctttacgggtcgaatacgggcgaaaagcagctgattttgctgctgcactggacaaaagcatgctcgaagctttctttcggattgatacggttggatgggcgctgatggaaatgaatgagcttgaagaggcgctcatacaaattgatgccgggctaaagcggctatccggcctggatgctggcaatgaggatacccgcgacttgatggtctgggggcatgccttaaaatcaagggtgcttctcaaagcgggcgaccccgatcaggcagaggccattcttagcaaagtcattccggtcccatccaccccgatgatcaggcaccgtgttttattggtccagggcgatttatatttggaacggaaaaaatacaaagaggccatccgtgcatatgaagctgcaaatcaaatcagccatgcttacggcggggaaaagacgattgaagcctattttaatctcggcatcgcatacgtggaaaatcagcagtttgaaaaagcggcggcggcatttgaaaagatgctttatcaaaaaaataaagccaacccgattgagttaatgtactatcactacggcatggccagattatttgccaaaaaaggcgatttggcatacgccctttattccagtcaggaagcccttcatctcgctgcgtcatgggaacaaaacatcagcatccgcgatgaaacagaaaaattcaatcagtttataaagaaaaaaatccaatatcaaaacggatgaatggcgtcggtctaggtgcccgtgccataacgagccttgcatcagagaaaaatgacaaacagccggcgcaacttttcaacacagacgtcactgctttagcgaaggcagcataccgtactttttacgaaaaacacccggagcccaggaaatggaatctgcgaaaaaagaaacaggctgcatgttataatgaaccatggcatatataggaaaaaagcagaaaaaggaggggcctgccgtttggaggtggaatcatgcgcaaagcaggcgcccggattgactttttgaaaaaggagcacaaacatgttaaaagaagaaacacaacgaagcattacgcctgaatacgatccgtgggaagcatacatggacatcacgacgcacggcaaactgactttgtcgaatattgaattcacaacgaccactttatgcaatatgcgctgtgaacattgtgcggtcggttacacgctgcagccaaaagatccggatgcgctgccgcttgatctgctgctcaggcggctggacgaaatcagcacactgcgctgcatcagcattaccggtggcgaaccgatgttatcaaccaaatctgttgaaaattacgttctgccactgttacaatatgcgcatgaaagagggatccgcacccaaatcaattccaatttaacaatgaaactcgaaaaatatgtgcaaattgtgccttatctcgatgtgctgcacatttcccacaactggggaactgtccgtgattatattgacggcgggtttgccaacatgcggatcaagccaagcgatcagcacggggaaaaaatgttcaggcgcatcgtagaaaacagccgcgccttgtcggagatgggcgtgatggtttctgcggaaacgatgttgaacaaacgcactttgccttatatggaacaaatccatcatcagattgtcgaagaaatgaaatgtgcaaggcacgaaattcacccaatgtacccaagcgattttgccgctgatcttgaagtgctcagcctggatgaaatccgggaagccatccaccatttgctcgatatccgtgatgaaagcgtgtggatgttgtttggcacgctgccattttatccgtgcagcactaacccggaagaccaggcattattgaaaagattgtacgaaagcaaaaatgtgaccctccgcaatgatccggacggccgctcccgcctgaatgtcaatatttttaccggtgatgtgattgtcacggattttggcgatacaccgccgcttggcaatatccagcatgacagactgcccgacgtctttgaaaaatggctcaaaacacccattgcaaaatcgctgaactgtcattgcccgcaagtcaaatgtctcggaccgaacattttagtcaaaaatgcttactataaaaatattgattttacccaacgaaaagcagtcatcgacatgcagggcgcctcttccaggatgggctaaaaatggcagaagcatggggtgcgcctgccccatgctttctcgtaatctcaactacttttatcctggttattttcattctaatgcgttacaatacgcaacaaagatgattggatgcagcataaaatgacttttgatcaggagggaataaaattgggttggttgatcgggattatcattattatcttgctcgtgtattttttaatcatccgtcctttgatcgagcggaaccgcccgcaaatcattgaaccgcgaagaagcatttacaatggagatgcctatgacccgcacccggagcaaaccggatggaacgaggggggcaatgccggaatcggccggtttggcatgtttgccggcgggatggcaacaggcgctttgctgacgtatttactggaacagggcagaatcggtttagaccagttcgagcattttcaaaatcttgatggcaacgatctgttgcaagaactggaagagcaaaatattttacaacaggatgagattgaccatctccaagatactttaagcaactttgaagacaatggccatgacggtcatgaagacggggatcatggagaccacgaccagcaagataccggttttgatttggctcatttcagttcccatgaggatcatgacacacatgacaacgaccagcaagacaccggattcgatctggctgatttcagttccaatgatgacaatgactttggcggatgggatagcggatcggatgacaataactggctgtaagcatataaacagaacaggtgccgcaaccaaaagcagatgcaagttatgacttggtggaggctggctttaaaaaaatttacggaacaggtgctgcaactgcctgttccgtttccttatgacgggtttccagcaggctaacctgcattggcatttgcccaaaggctttgcaagggctagaacttagaaatgagattggcagcgtagaactatttacaactttgtccaaaggttttgcaagggctagaacctaccgctccgggcaagacagatccatcgctgttccattgtttgcagcgacagtacccactcgaatcttggcgaaaaacatactagaagcactcggggattcggattccgtttttatcggccatcccgcgggtgctttgcttacaaggtttacggtttgtactttttttcgcttgaagaagtcgtttttttgtcatgatccgttttttcttcaagcttttcttctcgcaagtcttccattgggatcgggtcaactgtttgttcactcataaatttatcatgcatgtcttcgttttctgttgcaaattgttcggggttgtccattttccgttgcgatttctttttgttttcgttcatttcatatcacctcgtatggttcaataccctttatttttccgaaaaaaacagaaaatatccgacgaacatgcaaaaaataaaccgtgcctgtccaccccaaggggcagagattttgtgtttttctcgtattctctgttaattgttgcaattttttatgatatgataaggttgatgagaagaaagccgatggagatgattttatgtttaatcgtattcttgtggcaatagacggttcaaaaatgagtgaaaaagcactgaaatccgcactgaattttgcaaaagaaaggtttacaaaaatcggtgtcatccatgtggagaaaaatccggttattccggaggggatgccaaatgcgtcaatagataccctttattctgaacagcagagggacggggacgatttgctagaccaagccgccgctcttgctgaagaggaagaaattgagatagagaaattttatgaaacgggcgatcccgctgcccagattgtcagaaaggcggaagaaggaaactatcagcttatcattatgggaagcagaggactcggcaatctgaaggggctcatgcttggcagcgtcagccagaaagtcacccagcttgccaaatgtccggtactgattataaaatagtcctgtttcaaaagcctgtcctgaaataccggacaggtttttgaaattgaaccgggcaagtgcctctctacatataggccccttacgtaaacttatccccaaaaatccttgttttcctttatttagacgtgctctacgtgaacttatggttggattttcgcattgttccttaacatagaacctagaaccactctatgtgaacttatggccggatttttgcattgttccttaacgtagaactgctctatgtgaacttttgaccggattttttgtctgttccttgacgtagaaccattctatgtgaacttttgaccgattttttcgtctgttccttaacgtagaaccgttctatgtgaaattactatcaaaaatttcgattctttctcgttccccccttataaaacgatcaagctgggttatgttgcacaaactttcaagaattaccgcggaccctcacaaacccggacaaacatccaaaaagcctgccggaacccgtatatctaccgttaaaaagtatgtttcattgatttgcggagaatcagggagatttcaatttttttacaaatcgttaaatagtgcatcatcatgataagcaatgttcccgtattcatagcgatgatgacgccggccatttggtactggggatttgagccaagataataaatgaggcagtacgtaaccattgttgaccaaataaaatgcgcgagggcatccctgaccaggccgaggccgattaaaaacgcctgcatcggaatgacaaaatagtgaaacagaaaatacggccataacagacggacataaacggcggcggcagccgaatgggaaaacaaagttgtgagcggcacggaaaacacctgaatgacaatgacagccggaagcccgtaaagaaacgtcatcatcatcacctgctgaagcagtttctgcagctttatgccgtctcttttggcataagcttccgaaacagtcggaattaatacggtggacagggaatgggcaataaaggccggaaaaaatccgatcgtaaaagcgacgccggccaccagtccgaaatgttcgtttgccatcccctccgtcatcccggatttaagcaatacccatttgataaaaaatggttcaatcgcatttgttacggcatgaaatacgcgcatgcccgttgttggcaaggaaacagaaagaaggctccttctgatttcctttccccccattggagcctgttcttttttcttgagcgtccgcatttgcagcacaaacatatgaaaaagatacagcagcacaatcaagtcactaccgacaagcgtgcatatcgcgataaaaattgacatttgcacgtcaaattccatccaatgaaatagcaagacaagcaggataagctgcatcatttttctcaggaagttggcagcagcaatcttccccatttgctgaacacccataaaataacctctcgcaattgaggaaaaggcgatcatcgggataagcgcaatgatcagccagcgaagatacgggtggtaatgatggaaaattggaagcaccggcagcaacaatgcaactgccgccatgagcaacaggacaaacaaagatgccagccggattgtaaacctcagcatatcacgatgatatttttcttcctgttccgcaacaaattttgaaatggagatgggcagttccatgctggcgatggtgacaattagaaaaatggccggcaaaatagacatgtatagccccatgccgtgcgccccgagttcatttgcaagtaccatattggttaaaaattcaatgcactctccgatgaaagcaacgccaatcagcataaatgcccctttaaaaaacactgccatgttcttcctcttctccttatcaagaaaaactttttcaataataaaggatatgaggcaagcctggagaatcattacaaataaattaacagagatgggagaggctcctgtgacagaagaaaacgtgattcgtcaaaaacaaatgctcgtaacaaaagaaagattagtgacagattttcgcaagcttgggctgaaagaaggtatggtggttatcgtccactcgtctttaagcgcgctcggctgggtttgcgggggagaggttgccgtcattctggctttaatggaagtggtgacagagcgtggcaccattgtgatgccggcccaaacagcgaataataccgaccccgccttttgggaaaacccgcccgttccggaagcatggtgggaagaaatccgccgctctatgcctgcattcgatcccgccgtcacgccgacttacggcatgggccgggttgccgagcttttccggacgtttccggaggttttaagaagccatcatccgacctgttcgtttactgcctggggacgggatgcaaaatcgattttgagcgggcactcgctcgacttcccgttcggggaaaagtccccgctcgcccggatttatgaccgggatggctgtattttgctgctcggcgtcgattaccaagtcaatacatccatgcatctcggcgaatccaggtccaagcatacaaaacggtgtacgcagagttgcgcgatgacgataaacggaaaaagggtctggcaatcctatgaagattacgaggaaaactccgatttattcaataaaattggccgcgcctttgaacgcagccatcaagtaaaaactggttttattggcgctgctccgtcaagacttatccaacagcgggcgctcgtcgactttaccgcgcaatatttggatgagttatacacggatacggaaaaagcgcaccactagttttctaatttccttttcgggcggatcccagcgtgcacaacagaccggcttgctgctattgatacgccagcatcgggttgccccaatctgcgcctagcacaacttcggcagcggccaattgatccatcagcgttaggtttgctgcctgccgctatcgatatatcagcttcgggcgacccaatctgcgctcagtacaacttcggcagcggccaattgatacaccagtgccaggttgctgctcgcggctatcgatacaccagcgtcgggcgacccaatctgcgcttagcacaacatccgcagtggccaattgatacatcagcgtcaggttgctgctcgccgctatcaatacgccagcatcgggttgatatatcttcattcacccgtttcctcggccgcttgtgatttcgcatgtacgcagtcgatttgcacagcacactcctttgcaattaagaacccgtaatcgtcccgccgtttacatgcagcacctgccctgttacatagctggaatcacgggatgcaagataaacataagtcggagccagttcgtacggctggccggcccgcttcattggcacatcacggccaaatttggcaacctgttccggatagaagcttgccggaatcagcggtgtccaaatcggccccggtgccaccgcattgacccggatgccctttctcaccagattttgcgacaaagcccgggtgaaagccacaattgccccttttgttgcagaataatcgatcagattttgatttccttcatacgccgttacagaactggtaaaaatgatcgagctgccggcttttaaatatggcaatgcggctttgaccaagtagaaaaaactgtgaatattgtttttaaaggtaaaatcccattgttcattcgtaatattcagcaagtccttctgcacaaactgcatggcgtgattgttcacaagcacatccagatgcccgaatgtatccaccgtttgcttcacaacgttttggcaatgctccggatcttttaagtcccccggaatcagcaggcaacgctgcccgagcgcttcaatcctccgctttgtccggacggcatcttctatttcataattggaataatacggaatcacgacatccgcgccttcttttgcaaacgcaatcgcggtagctgcgccgatcccgctgtccccgccggttacaatcgccactttattttcaagctttccagatcccttataggacgggtcttcaatcagcgggcgcgggtgcatcagtttttcaatccctggctgttccggctggtgctgcggcggaaaggcatatttttgcggatgattgcggtaacccggttccgtccgggaaaaatacatatctggcttctgccaatacaattggaccacctctttatccaggctttttccattcagtgtattcgcctaaaagccggtgggtgacaattaatttccttcatttgccggcactttttccatcacaatctcttcgaaatgtttcacaagcgccagttccggatcgatggcaagcgggtcgtgccaagccagcctgagataggcttccgcgatccatttttgccgctgcccggccaatgcgtcttcgagggctgtgacactttcatatattttgaccatttgcctggctacttttttacaatggtacgtttgcgcggcttcctctttcgtctccatgacaaaacggcaagtttcttcgagttggtccagtccggcagatagccatgtaccggcctgcagctgatctattttctcccgcatcatgccgataaaaatgtcatgcactttaaatttccgcatcaggcggagcacttcaaggccgagaatattggcggtcccttcccagacagtaagcacctgggcatcacgcaaaagccttggcgttacaaagtcttcgatatagccgtttccgccgtgcatttcgatcgcttcatgggcaaaatggatggcctgctcggctgtttccattttcaaaatggcaatgagcagtcttgtcatgatgttttcttgttcatccgccttgccggaagccgtccggtcaaaaagtgtggcaagccggaacaccgcgcttgtttccacttcctgtttggctgccattttgacaagggtttcttttaccattggatagtctgcgagccggctgccaaacgccgtccgtctcagcgcataggcccgcgcttcccggtatgcccgacgcatgatgccgatcgaagcaatggcattgcagatgcgcgaaaggtttagggcctccatcatatagtaaaagcctttgcgcgggtcgccaaccaagtaagcttttgccccgtcaaataccacctcacccgaaggcaccgcgcacacgccgagtttatctttcaaacgccggatatagatgccgtttttctcgccgttttctttttcccacggcaccaaaaacaagcttagcccttttgttccggacggggccccttcacgccttgcaagcaccatagctaccccgcacatgcccacattagaggcaaaatatttttcgccgtaaagccggtaacagccgccttccgaaacggcttttgtttcattggcgccaacgtctgacccgccttggcgttccgttaaaaaagtggcaccttcatagcgctccgcttcacctgttgagattagctgcggcaaataggcttgtttcagttcatggctaccataatggtcaagcaaataggcggctgctgccgtcaatgtgaccggacaataaaacccgggttccgattgcgacagcaaataaccttgcgcaaacgcatacacataattgcctttttggcccaatgccggaatggatttatggacatatccaacaatgcctttgttatacacttgctccactgtttttaaataaccctcatttacacacactctcgatacatcttctccgtagcggttatatttgatcagcttgggctggccttcccggtccgtgtgggtcgcccgttcgtcaatttctccggcgcacatttccccgaattcggccagttccttttctgcccaatcaaaaaacagcggatccaaatattgtttcaaaagccgtgccagatttggatcatcatggtaaaagttcattggccttccccctcaatacttgtttttggatttttcccgtggcgttcctcggcagttcttctattctttcgtacaacttcggaattttataggatgccagtttcccttttagaaagcgtttgcattcttcttcaatattgtccatcggttctgccagcacgagaaaagctttgaccgtttccccccattccggatgcggaacaccgatcacagaaacttcccttattttcggatgggtaaccaatacgtcctcgatctctttcgggtatacgtttacaccgcctgagaggatcatatcttttttacggtccactacccagtagtacccttcctcatcttttctcgccatgtcgccagttaacagccagccattttgaaatacgcggttcgtttcttctggtttccggaaatatcctttcatgacgctttccccgtacaacgcaatttccccgacttcccccgccgctacgtcttcacctttttcattcacaagccggatttccatgccaagtgcagcgcgtttaccgatgcttccagctttttccgcgtgttcttcaggcagcagcaatgtcccgttcggccccgcttctgtcaggccatatacgcacacgagccggtccgaccgaaaagcattttgaatcaggcccacttccggtctggaaagcggcgcaccgccatatacccaatacttcatggtggataaatcgtaatcctgcaagttcggcagttttgccgtgaacaaataggccaccggggcaccgaagaaatgggtgattcgttctttttctacagtttccaccaatgcttccggtgtaaatacaggcgaaagcacatgtgtggcgcctacaaccgtgcctgcaaccaaaaagagatgaagaggcgctgaatggctgagcggcatcatgtgcaggattctgctttccggtttcattgccatttccacacacatcatccaggcggcggacaaaatattgcggttggtgaacaaaacaccctttggcttcccagttgtgcccgatgtgtaaagaatagaagcatcatcgtcttctttgagccggcaccggatctccgtttcaggcgaatggttaatcatttcttcaaaaatttgacagcctgtcacacgttcgcctgtttttatttttacgagatggggaggaaaagttgcttctttgagttcctcaaaaagcagctcatggacaaataacacgtttgctccgctatcgtccaacatatactccagttctgcgcggcttgatttggcattaaccggcacgacaatacctccaagccgcatcacggcaaaataggcaatgacaaacgcatttgtatttggcatcacgatgaccgccctgtctccctgcttgaagttacaattttggagggcatgcgccaaacggtttactctgacatttaattcctgataattcagccgttcacgaggcgaaaccaatgcttcctgctgtgggtactttcttgcattccgcgccaacagttcagaaatattcatccctgctcctcctttaagcgttttaaacgagtttcaaattctgccagatatttttccagttcggattgaagttcctggaggttttgaatttgctgtgcaacttcccggcgtttttgtttgccatactcgatcgtttttttgagttgttttatgccggagcggtcgcaatcgaacagttcgatcatttctttaatctcatccaaagaaaaatccagttgtttcccgcggaaaatgagctttaacctggtgtagtcctttttcgaatagcacctcctgccattttggcttctttttggcttgaacagcccaagctcttcataatagcggatggtcctcgtggataccccgaattcggctgccagttcagaaattttgcaggtcatacacccctctccttcccatttgcctctatcatacaatttacgttaacgtaaacttcaagatataaagcgtgaattccttttatcattatgaaacaattagaggggaatacgattatacaggaatgcgccattttgggattgcatgtcatggatttggttgattatgccagcctatatttccctaaatgtattgaaaagttgccgaagcgaatgctaaggaataattggttggtttttgaaggaagtttttaaggaagtgaccagaggaagttcaaacaccgttcagaaaatggaattaaacaaaataaaaagcagcaacatacccgtattcttcataaggagtggaagtgggaatgataaaaacacctcttccatcctaataaatgtgtctccccctctacctgccctgtttttaacttaatgtaatataaaaaaccatagataagcaaaaaggagtaaataagcaatgatgtagaaaagaatattccctaagcttggttttttataaatattatacaaggacataaaaaacaggacgatgaatgcaccccagtacactggtgtacgctgaataaaagtaaccagtaaaccgacaactaaatatataacggatgaaaagcttctacgtgttgaggattgacccattgatatcaccaaacttttttaagtttttaaaaatactatttaaaaaacttcccggtactgaacgaagaatcgttttgaaaaaatttcaaaaaatatacagatcatcttcttaatagacaaattattccatatataaatccaatagtcaagacacaattaaaccttttagggtggataaaaatccgattaggatgacaaagaccttcgcctttagtgagagaagaagacctccccactgatttgattcactatattattgacaacactcggtgttttggaaccatgtcactcccctctacgttacagtaaacttcaagacacaaagcccgaaatatgtaaaccaattttatttttaggttgacatatatgccgcagttttttaatctattaatagataaaggaaaaaaggggagtgaaaaaatggcagcgaaaaaattccgtgccattgatctttgttatgcgggtatgtttgcggcgctgatggccattggggcaaatattacatccattgcgccgtttcttgttatcggcggggtgccgatcacattgcaaactttttttgccgtgctggcaggtttagtgctcggcagcaggcttggagcgatctcgatggtcgcctatatgctgatcggcttactgggagcaccggtttttgcgcagttcagcggcgggtttcaaaccgttttaagcccaacattcggatttattcttagctttatccccgcagcctgggcaacgggcaagattgtggaaaaacgccaaaacttgacaacgtactttattgcggcaatcattggcctgattttaaactatttgattgggaccaactggatgtacgccgcgtacaaaatatgggcgcaggccccacaagcgttcagctacaaaattgcctgggtgtggatggcggtgcccctgccaaaagacatcattttgtccttggttgcgggctggctggcacaccggattaaagccgtttccccgctaattgcgttaaaacggtagaatggccccgcttatactgccccgcccgatatggtgatttttcaggcgggacagtatttcggagcagggcatttccccgtttactgcgttaaaacgacgggatctttccaaatgcatacttcagacccccgcttgacgattaaatccgatcccgctgcagccgcctgaaacggtgcattcttcgggtgggacagtattccggagcagggcatttccccgtttactgcgttaaaacgacgggatctttccaaatgcatacttcagacccccgcttgatgattaaaacgaggcgggctatttattccactgtagccgcccgaaacggtgattctctagggaggacaatgctccggcgcaccgcttatcgcgttagaacgatgggggttccttttgttacaatgacggtatgttccacttgcgctacaaagcttccgtccggcgttacatacgtccagccgtcgcccgattctaccacttcatcagcgccggtcgagacaaacggttcaaacgcaatgaccatgccgtcctgtaacaaacctgtatcgtctgggtcatagtaatttaaaatatactcgggatcctcatgcagggccttcccgacaccgtggcccgtcaaattcaagagtacttcaaaaccattgtcgtacactgctttttcaaccgcccggccgatttgattctgccgattgccggcccggatttttttcaggccgctgtcaaacgccagctgcgcacattcgcacagcgcaaataattcgggatctccttttccgacaacaaaagagatgcctgtatccgcataatatccatccagcgatccggatacatccacattcacaagatccccttcttttaacacgcggtctcccggaatgccgtgcgccacttcttcatttacactgatacaggtgtaacccgggaagtcatactctccctttggcccggagaccgccccgttttctgcaaacctcttgcctgcccattcatccagctcttttgttgtgatgccgggcctggctttttccttcagctcatcgcgaatgctggcaacaagcctcccgatttttttcagtccttccaaatccgcttctgacttgacgatcatgttgaacgttcctttctgctttaaagtcatgactccattatatagaaataacgttagatatcaaaatccatggttcacccgaacaaaaaaggatgccgtgccccgcatgccggacgccgtcaaacttttcacacttttgtcgtatacgtaatgtttttgtaatattatttaatgtgagcgtaaccaaagaatcgacaaatattggtatagtgggattacaagattcatagacagaggtgggaaatttgaagaaagtagctccaatactgcttgcattcatgctgggaaccggttttttactgcctgctaaacaagcggctgctgcatcctattccccgtcaaaagtcatcagtacggcaaagaaatatatagggaccccgtacaggtggggcggcacaagcccatcaggttttgattgttccggctttgtaggttatacatttaaaaagaacggaaaaagcttgccgagaacagcagcaagcatttacaaaaaaggaaaaaaagtcagcaagtcaaatttaaaaccgggcgatctggttttcttccatacttattcaaaaggcgtttcacatgtcgccatttatatcggccataaccaagtcatccactccgtatcgcagggcgtaaagatcgacagcctgagcaatccttactggaaaccgcggtacgtcggggcaaaaagactttgagatcaaaaaacttcggaaactcccgatgttttttttgcactttttcctacctctaccccttccccggaaatctaaaccgggatacaaaaatatgaattaaaatttttccataaatcttattttttcctcccctatttaccataagaaacaaaaaatgctatgatcgtgctgcaagtctattaaaaatttacagatttaggaaggggttacagcatgaaaaaaatttggtttgcaacttttagccttgcccttgtgcttgcacttggcgcatgttccggaaattcagggcagtccggggcaaagaaaccggcaaaaagcagcacaaaaacagctttgatgaatttttatatgaatctcaccaatcatatcaatgcccaggacagggatttaaatacgtatgaacaggcgatcgctaagacggacgaaaaaccgccgaaaactgagcttgccaccatgcagaaggaagcgcagtcatccgcagaaaatgtagtgaaagaaattaaaaatacgaaaatcccatccaaaataagtagctatcaatcggagatcaaaacggctgtaaaagatttgcaacagtcctaccaaatgaaagcggatgagttgaaaaaaacgaacccttcgctggatgctgcgaacaaaaaactggaacaagccaacgatgaactcggcaaagtatttaaaaaagccggcttgtcaccggccagcctcccggacgatgttaattcataaggaagtttcaaaatataatcgggcgattgccgacccaaacggcttccgctgatgtccattcagagggaagtttcgaaatacaatcgggcgatggccaatgcccattcaaagggaagtttcaaaatacgaccgggcgattgctgatactcattcaaataaaagtctcaaaacacgaccaggcgatggccggtacctattcaaaaggaagtctcaatacacagctggacgattgcctatgcccaattaaaaggaagtccaaaacagaaggcctgccggagaatcgatttccggcaggccttctgcggcatgaaagacaacgaaactttgtatttcatctttttaaagcagaataatcttcccgcttttggaatccgcccagggaatgaagccatcctccggacaaatttttcgcattcaaaaaaactgatttgcctattcgggatctaccagctcaccgcgctttatgtcttttcgcctcaattccacatgctgcgcttttgcatattttttcaacaccgtttcttctttcggcgtgacaagagagacaactgtgccggggtttgaaccgagccggcctgtccgtcccgaacggtggacatatgcggaaccatcttccggcaaatcaaattgaatcacatgcgtaatcgccggaatgtccaggccgcgggcagcgacatccgttgccaaaaggagcgggacatcgccgttttggaacaaccggatacttttttctctttcttccttgcgcatatcgccatgcaattcggcgatggccagccctttgaaccggagtttttccactgcaaccgaaacatcccatttattattaaaaaacacgagtccccggacccccattcgggctatctttcgcaactgctcgattttgtcgcgcggatcgctgcttacgatataaatatgttcaaccgggctccgcgcctcctcttttgcaatgcgaatcaacaggggttctttcatctgttccatagccttatgggctgcagcatcaggcaaagtggctgaaaacaaaaggagctggcagtcacgcatggcggattttacaatttgtccgaccgtgcggctgtattcctttccgagcagctggtccccttcatcgagcaccatcattttcacttcatgcattttcagttttttctggtggatcaattcaaggatgcgtccaggcgtcccgataacaaggtgcgggtgttttttcagtttttcaatttgccgtttcacattcgcgccgccgatcagcgggatgctccggattccgcttccctgtgaccattttccggcttcctcttggatttgcatgaccagttctttagaaggcgccagaatgacagcttgaaccgtttgttttccggggtccatccggtcgagcacaggcagcaggtaggcgagtgtttttcccgatcctgtcggtgctgcagcaatcacatcccggccgtccagcacagcaggaatcactttttcctgtacagaagcaggatgttcaaacgttgaatttttccatgcctgttgtaaaaaaggctgtaaatgatgaatgaatgtaggttccattgttttttccctaaccttccttttccagttcttttatcatacactatcccgtatggaaaagaaaagttatctaacgtagacccgttctatgttaaggaagatcgcttaatatcgcccctatcttaacgtagaggcgttctatgttaaggaagaccgccaaaaatcgtccctatcttaacgtagaggtgttctatgttaaggaagaccgaaaaaaagtcatgctttcttaacgtagacccgctctatattaaggaagatcgaaaaaaatcgcccctttcttaacgtagacccattctacgttaaggaagaccgaaaaaaagtcatgctttcttaacgtagacccgctctatattaaggaagatcgaaaaaaatcgtccctttcttaacgtagagccattctacgttaaggaagaccgccagaaatcatccctatcttaacgtagatcctcgttccttaccttaaaaacccgtctaagtgaagtgatcgccaaaattctggctatttccttcacttagacgggctctatgttaacggatcaacaatttttaaattgcttctttttcatagacacgggctacatgagcgttttcgccaaaacctcttcggttcccttcacgtaaagtgcgcctcttccaaaatgaaagccattattttgcttcaacgccttcaaaagctttgcgtaaaatgtcttccaattcgctgacaagcggcaatttagggtttgcaggtgtgcattggtcttcaaatgcgcggtctgcaataatggcaacccgtttttcaaagtccgcccggttcacgccggctgcttttaggctaagcggaatattgaacagtttgcacatccggatgatttcctggcaaaggctttcgacaccttcttctgtcgtgcttgccggaagaccaagtacgcgcgcgatttccgcgtagcgttgatccgcaataaaatgttcgtatttcgggaatgccgcaaattttttcggcttttgcgcgttatagcggatgacatgcggcaacagaatcgcgttagcccggccgtgcggaatatggaattcagcgccgattttatgggcaagtgaatggttgatgccaaggaatgcattcgagaacgccatccctgccaaagtcgatgcattgtgcattttttcgcgtgccagtgcatcattgccatttgcgtatgctttcggcaagtattcgtgaacaagctggatggccttaattgccaggccgtccgtatagtcgttggccatgttggatacataggcttcaatcgcatgggtcaaaacgtccatcccggtatcggctgttacggatttcggaacggtcataacaaactgcgggtcaatgatcgcaacatccggtgtcagttcatagtctgcgagcggatattttgtgttgttctttttatccgaaatgacggcgaaagaagtcacttcagaaccggtgcccgatgtggtcggaatgcagaccagctgcgctttttcacccagtttcgggaatttggcaacccgtttccggatgtccataaatttttgcttcaattcgttgaaatcaacttccggatgctcatagaacagccacatgccttttgcagcatccatcgccgacccgccgccaagcgcgataatgacatccggctggaagcttgccatagctgcggcacctttccgaaccgtttcaatagacggatccggttcgacttctgagaaaatttcacagtgcacatagtccgggcgtttccgcaagtaatacagtactttctcaacgaatccaagcctgaccatatccggatcggtgacaataaaggcacttgagatatccggcattttttccaggtattggaccgagttcttttcaaaatacacgcgcggtggaattttaaaccattgcatattgactctccgtttcgccattgtttttacattgtaaagattgatgacaccgacgtttgtggacaccgagttgccgccaaacgtgccgcagccgagtgtcaaagaaggcatgtaggcattgtaaatgtcgccgattgccccttgcgaagacggggagttgacaatgatccggccggctttcatttttaagccgtattgttcaatgacttcatcgtttgtcgaatggatcacagccgagtgaccaagtccgccgaattcgagcatggcttctgcaaattcgaaaccttgttttgtgctgttggctttgtaacaggccaaaaccgggcttaatttttctctggaaagcgggtagtccgggccgacacctgtaagttcggcgattaaaattttggtatcttccggaacatttacgcctgccattttcgcaatttcataggccggtttgccgacaatggcgctgttgacggattgcgtcttttcattgatgacggttttctcaacctttttcttctccgcttcattcaggaagtagcattgatttgcaatcaattcgtttttcacattgtcataaatttctttgtcgatgatgacagcctgttccgacgcacagatcatgccgttgtcaaacgttttggacaaaatcaaatcattgacggcgcgtttgatatcagcagatttttcaatatagcaagggacgtttcccggcccgacgccaagcgcaggtttcccgctcgaatatgcggactttaccatgccggaaccgcccgttgcaagaatcagtgaaatacccgaatggttcatcaattgctgtgtcgcttcaatggccggtttttcgatccattggatgcagttttccggggcgccggctttcacagcagcgtcaagcatcacttttgcggcatggctgctgcatttttgtgcggacggatggaacgcgaaaataattgggttgcgtgttttaatggcaattaatgctttaaacatcgtggttgatgtcgggtttgttacaggagtgaccccggcaatcacgccgaccggttccgcaaatttaacaatcccttcattattgttttcgtcaatgatgccgactgttttgttatatttaatgttgtgatagatgtattctgttgcaaacaagttttttgtcattttgtcttcatatacgccgcgccctgtttcttccacggccattttggcgagcaccatatgctgttccaacccggcaagtgccatttgttttacgatattgtccacttgtgcctgatccagttccataaattcacgcagtgctttttgcccttttgcgacgagggaatcgaccatttccgtgatttgcgcagatttgccaacaactttttcatcgattgccatgttcgtggcccccattctaaatgtttttgtgaataatttcacatgacaaactaaaaaaatataatttgtgaagtatttcacatgattttctgccgttttacatttgtttcttttctttatggctttattataggcgatttcacatgctatggctgtgtcagattggtgacaaatgaataaatcatttataaacttttttctttaaaatattgctttccagctatgatttaattaaaataagttttttccgcctttttacattgtaagtgcttacattttatatttgaatattaataagtaaagcgtttgaattaaattggatgattacgagggattcagtatgttaattcggtataaaaaatctttcgataagattgcaatgggcctgttgtcctttatgccagatgaaaaagatttgaaaaagctgcagcaaacaaagcaattgtacgaaacagaagacaagtggcagctttttttatggaaagaggatgatgacattgttggcctgatcggggttgtactggatggggacaaagtggaaatccagcatatttccgtcaatccgtcttatcgcgaccaaggaatcgggaaaagcatggtcaaggctttaaaacaaatgtatgaaggaaaagaagtggttccgaataaatacattgttgacttcttccataagtgtgctgaaaaagaagacctgtcctgaccgggtcttcttttatttcggatacggcaaaaaggacctgccggcatgatgccggaggccctttttacggttaccagatatacgcactgccgacaatgatcaacaaaataaaaagcacgacaattaacgcaaatccgctgccccagccaaaaccgtcagccatgataacccctccctcaacagtcattacatggtatactatgtaggcgcgccggaacgtgtatggactcctgcccatctgcgcgcttttgattggagatacatacgtttcaggctatacttattttgacgctttgaaaaaggaacggtgtacaattttatggaatataaggtgaaaatcggcgcgtttgaaggaccgctcgatctgcttttgcatctgatccaccagcttgaaatcgacatttacgatattccggttgctgaaattaccgagcagtatttggactacatccatacaatgaaagagcttgaactggacgtcgcaagcgaatatcttgtgatggcggccacgcttttggcgatcaaaagcaaaatgcttttgccaaaacaggagccagatgaaccggatgaagattatacggtggaagaagacccgcgcgaacaacttgtcgagcgcctcctcgaatacaaaaaatacaaggaagcagccagcacgttcaaacgccttgaagccggccgcagcgaaatcttcaccaagccgccgagcgatttgtcggcgtatgcgtcggacgcagatggaagaaaaatcggcgccaatgtgacgatctatgatatgatcggcgcgttaaataaacttttgcgcagaaaaaaattgcaaaaaccgctgtttaccaaaatcacacggcaggaaatctcgatcgaagaaagaatggatgaaattttaaaacagctggaaacggcgccgggaagcgtccaattttacgacttattctcttttcacgataaagaacaaattgtcgtaacttttttggctgtcctggaactgattaagcgccatcaaattatggcggtacaggaagaaaatttcggtgacattaccgttgtaaggaaagagggggattgatatggaaatcgtccattggaaaggcatcctcgaaagcctgttgtttgttgcaggggacgaggggctttccctgaagcaaatttcccatgtaatggaaattgaagagtttgaagcagttgaaattttaaagcgtttaaaagaacaatatgaaaacgacccggatcgcggcattacgctcattgaactggccggcacgtaccagttggcaaccaaaaaagagcatgcgccgtatttaaaaaaactggtcgaatccccgaatacgaatacattatcgcaggcggcacttgaaacactggcgatcatctcctataaacagccgattacaagaattgaaatcgaagaaatccgcggtgtgaaaacagaaaggccgctgcagacgctgatggcaaaagggctcatccaggaagtcggcaggcaggaaggcgccgggcgggcaatcctttacggtacgaccaaagaatttcttgaccatttcgggctgaaaagtttaaaagaactgccgccgtttcccgaacagccggaagacgaattttcgcaggaagaagcagatctgttttttgaaaaattccatgaagaaaaaggcgaaaacggattttcgccgtgaagaaagcttgcccaaattggtgcaggcttttttcgtctcacacatattccggttatttcttcctgttccgtgcataaacttgtacaaaacacggtttggaaaagctgaaaaaaggagcttctttatgaaacggtacttcctatatgcggcgcttgcagtgcttgttttttcggcccttccgcccggagcggctgctgctgatacgccgtctgtgcaggcaaaaagcgcgatattaatggaccaggatacagggcggattttgtacgaaaaagatgcatatgaaccgagaagcattgcctcgattacgaaaatcatgacggcgctagtggccattgaatcgggaaaaatggacaaggaggctgtcgtttcgaaccgcgccgtacgtaccgaggggtcatcattgtatttgaaaccgggagacaaatggaaaatgaaggatcttgtttacgggctcatgctccggtcgggaaatgacgccgccaatgtcattgccgaaaatgtcgggggcagcatagaaggctttgtttttatgatgaacgaaaaagcgaaggagatcggcatgcatgacacccattttgccaacccgaacggccttgaagacccgggtggccgccattattcgaccgcttacgatatggcgctgttaatgaaatacgcgatgcaaaataaagagttccggaaaattaccggcacgaaattttacaaaggctggcggaacaaaaaccggctgctgactgaaaagtaccggtactgtacgggcgggaaaaccggttatacgaaagcggccagacggacacttgtgacaacggcggcaaaaggcggcgaaaatctcatcgccgttaccctgaacgattcggatgactgggatgaccatattgcgatgtatgagtacggcttcagccagtatgacaggaaacggattgtggaagaggggccggttgccgccgtccgcacgaaatatttgaaacagcatgtttatgtgaaacgggatatcacctacccgcttaaagccggagaagaagacgccgtaaaagtcgaataccggatcaaaaagcctgaaaattcgtggaaagacccggaaaaagtgccggagaccgtcggaagggcgattgtttatttaaacgaaaaggtgatcgcgagcacgcctatttattatcagaaaacgccggttaaagagaaagaaacatggcttgaacagttcaaagagacattttggatccaattggggctgaaaaacaatggttaattatatttggatcggcatggccgtgatcgggctcgtttttgcggcggtaaatggcaagatgcaggcggtgaacgaggcgatttttacatccgcgcgcgatgcggtctcgatcagcatcggcctgatcagcgttcttgttttctggctcgggatgatgaagattgcggaagtttcaggcctcctttcaaaactttcccgcctgttccggccggtgataaaaaaattgtttccggatgtgccggacaaccatccggcactcggctacatcctctccaatatgattgccaatatgtttgggctcggaaatgccgccactccgctcggcattaaagcgatggagcagctgcacgaactgaacggaaggaaaccggaagcaagccgttcaatgatcacgttccttgctttaaacacatccgggctcacacttattccggcaacggtgattgctatccgcctgaatgcaggttccgcgcatccgaccgagattgtggcgccgacctgcatcgccacttttgcaacgaccattgccgccatttgcattgaccgctatttttaccaccggcggacgaaacggaggaagtgatgtttttgaaatggatctcactgatttcaatttggctgattccggcaatggtcggatttatcctgctttacagcgcatggaaaaaagtgccggcttacgaaacatttgtggaaggcggcaaagaaggcattaaaattgccttttccatcattccttttttagttggcatgcttgtctcgatcacaattttcagggcctcaggggcgctcgatttttttgtcggatttttaaaaccggccctgcatttgctcggtatcccatctgaagtcgtgccgcttgctttgatccggccggtttccggcaatgccgctcttgccctgatggcggatctgatcaaaacatacgggccggactcgctcatcgggagaatggcatccgtcatccagggcagcacggataccaccctttatgttgtaaccgtttatttcggggcagtcggcatccggaaaatgggggacgccttaaaagtcgggctgctcgccgatctgttcgggattatgattgcgattttcatggtgctgttgttattctgacgcggtaaaagaaaaaacggtttctccgtcatttcagggtgcttgtttcgctcgtccggctttgcattttatttacgttatgccataatgcttaaaggatagtttaagcaaaacagattgaggtgtaacggatggaacgtttgcaaaaagtgatcgcacaggccggtgtcacatcccggagaaaagcggaacagctgatactggaagggaaagtaaaagtgaacggggagacagtcagaacgctggggacaaaagtatcccagtcggataaaattgaagtggaaggcattccgcttgagcgtgaagaaaaagtatattaccttttttataaaccaagaagggtgatttccactgtcagcgatgacaaagggagaaaaacggtaagcgattatttccgcgatgcgggtgcaagggtttatccggtcggccggctcgactacgacacgtcgggccttttagtagtcaccaatgacggtgaatttgcaaaccttctgatgcatccgcgttttgaaatcgacaaaacgtatattgcaaggatttccggcattccatccaggcaggaattaaagcagctggaaaaagggatccggctaaaggacggcatgactgcgcctgccagggcaaaactgttgtccatggacaaacgaaaaaagaaagcgatcgtccagcttacgatccatgaaggcagaaacaggcaagtgaggcgcatgttcgaacatctcggctacccggttgaaaaactgcggcgcgaagcatacggcatgctgacattaaaaggattaaacgcgggcgaaaaaagggagctcaccccgcacgaagtcaagacgttaagatcccttgccgaaaacggcggcgcctcccgtaaataaaagcgcaagttaaggggcttattttgttcacaaaaacttcaaaaaacagcgaaaaaggacagaaaaatgttataatgtatgagagttgtgtgacacttttggacagggggaggagcaatgtcacaaacgaaacagaaacgtctcattttccgcgccgcgattctcgctgttttggtattggctgtcggttacacactgtatgcaaatgcgacgaaggagtcgcggggagcgcttgcagcgggggataaggcccctgattttatcctgaaagatttgaatgggaaaacgtaccggttatctgattataaagggaaaggtgtccttttgaatttttgggggacatggtgcgagccgtgcaagaaagaaatgccttatatgaatgaactctattcgtcctataaaccaaaaggcgtggaaattcttgccgtccacgtaaaaaatacgcgctttcttgtggacgaattcgtgaaacagtacgggcttacgttcccggtgctgattgataaaaacggtgatgtccagcatgcgtatcacatcgacccccttccgacaacctttttgatcgggccggacgggaaagtcaaaaaagtgatcattggaaaccaaaacctctccaaaaaagacattcaggacatgatggatatgatcaaaccataaccgaggagagagacaatgaaggatataaaatgtgagtgcggacatgtgaatcctcccgggaccgttttgtgcgagtcgtgcgggaaagcgctgacagcagaagcggaggcggcagtcctccatgatatgcggtatgaaggaagcgcgcgcaggtcgcaagtgtataaaaaaacgccggtggataaaatctggaattttttttcgtccgtaaaaaccggtgtctggctgattgtcctgacgttaattgcgtcagcactcggcactgtgctgccccaggccgactatatcccttccaatgtcgacccgtccgagtattacgagaatcagtacggctggttcggcaagctctggtatacgctcggatttgataacctgtacaattcctggtggtatctgcttttcatcgccctgatcggcgtttcgctcgtcatttgcagccttgaccgctttatcccgctgcgccgcgccctctcaaaccagaaagcagcgcgccatgaagggtttctgaagcggcagcgcctgtacgtgaaaaaggaaggggccatcgatgacgccgcttatgcacaggtcaaacaccggcttgaagcgaaacattataaaatccgcgaagaaggcgggaacttatttgccgagaaaaatcggttttcccgctgggggccgtacgtcaaccatatcggattgatcatctttctttgcggctctatgctccgctttgttcccggcatgtatgtcgatgaactggtctgggtgagggaaggagaaaaagcggtgctccccggcacaaacgggcagtatgtgctcctgaacaagcaattcaagctgcaagtttacagcaaaaaagacaatcaaaattttgaatcggcactgaatagggtcggcaatgttgcgaaaaatttcgagacggatgccgtgctttacaagcaggggaaaaagcgcgttttaggggaagacgccccgcttaaaaaagtgaaattctaccgcatccaggtcaataagcctttgaaattcggacattacgccgtgtatcaaatggattacaagctggatgaattccaggcgatgtcttttgcttttgagaagaagtcgaataaaaaaatatacggcaaacttaaaattgacctgtaccatccaaaggcggagtacccgctcggaaacggctataaagtcaagctgctcggctactatccttcgtttacagggtttgccaaaaacggggagccgcaaacggattcgtatattccaaacaatcctgcttttctttttagcttaatttcgccggagcatccgaaaggggaaaaaagctttgttgccatccgtcagactgtggaaccgctcggaaaaaatgactacaagctggcttttgccgggcttgaaacgcggaatgtttctgctttggccgtaagaaaagacgagacgctctgggtactggccgttgggggcgcgatctttatgatcggggttattcaaggcgcgtactggaatcaccgccgtttctggctgaagcgggagaaaggcgccgtgcttttggcagcccatacaaataaaaactggtacgggctaaaaagggagctggaatgggtgctcagcgcatccggcatgccggcgcttgttgacagaaaagaacggaagaatccgcaacaggcccatacggcttaaacagacaggagcaatcggatgaggagggggaaaattggaaaatctggtcgaaacgagcagccggttgttgttcgccgcatttcttttgtatttaatcggcactttactgtttggcggcgcgatccgcacaccgaaaaagggacagggaagcactgggccgcaaaaaacgaagtggggaaattttgcgatcttcgcaacggttgcggggtttatttgccaggccggttattttattacaaggtggatcgcatccgggcatgcccctgtaagtaatttatttgaattcactactttttttggtatgatgcttgttggagcctttatggtcatttattttctttacaggagtgcggtgctcgggctgtttgctttgccggttgcacttcttttgattgcctatgcaagcatgttcccgaaagacatcaatccgctcgtgccgtctctcaggagctactggctgcagattcatgtgacaacggcggccgccggggaggccattcttgctgtcagttttgctgccgggctgatttaccttgtgaaaagcactgatcagcaaaaatcaaaccggcagactttctggctggaatttgttatgctttgtttaatctgcatcgccggttttattgtcgcaaaatccgctttcggcttgtttcattacaaagcggatttcagctggattgaccgtaacggggcaaaaaacacgggggaaaatgccctcgtctaccatatgccggctgttatcgggccgcatggcggggaacttttaacagctgggagaatgacgccgtggttttatgtgccggcctttatcaatgccgtcaaactgaacacggtgctctggtctgttttgagcggcatcattctttacgtgctggtccggttggcggccagaaagcggatcggcgcgctgttaaaaccgctcaccaaaaatataaatgcggatttaatggatgagatcggctaccgttcggtattgatcgggtttccggtgtttacgctcggcgcgttaatctttgcgatgatctgggcacaaattgcctggagcaaattttggagctgggacccgaaagaagtgtgggcactggttacgtggctgttttatgccgcttttctccatttgcgcatgtcaaaaggctggcaaggtgaaaaatccgcctggctggccgtcattggctttgccattattctgtttaacctgattgcagtaaatcttgtcattgctgggctgcattcgtatgcctgattttgtaagcttttgaatcctgcgcatccccgggagccccacccggggatgcgggcggcttgcatggccccgggaagcccgcaaggattttaccggctggatgaatcttgctcgcagcaggcggctgatattgactgaggaggaatagccatggatgaggatgtaaaaattttagtggttgatgatgaagaaaggatccggcgcctgttacgaatgtatttggaaagggaaaattacacgatagatgaagcggaagacggcgataccgctttgaaaatggcgcttgaaaaagactacagctgcattttgctcgatattatgatgccgggcaaagacggcattgaagtgtgccaggaattgcacgaaaagaaaatgacgcccgtgatcatgctgacggctaaaggcgaagaagccaacagggtggaaggatttgaagttggcgcggatgattatattgtaaaacctttcagcccgcgcgaagtggtactgcgggtgaaagccctgctccgccggtcgttgcaaacgggtttcttaaacgcggatacaaaagcaaaagacattgtcgttttcccgcatattaccatcgacaatgatgctcaccgcgtcacagcggacggaaaggaagtcaatctgaccccgaaagagtatgagctgctttattttctcgccaaatctccggataaagtgtttgaccgcgaacagcttttaaaagaagtatggcattatgaatttttcggtgatctccgtacggtggatacgcatgtcaaacgcttgcgggaaaaattgaataaagtgagcgaaaacgcggctaaaatgatcgttaccgtctggggcgtcgggtataaatttgaggttgcgccggaatgagaatttggcggacggttgtcgggaaactgtggatgaccattctgctgatggttgcctgcgttctgctcatcctgacggtactgttgctcaagttttttgaagaataccatatcaatcagattgagcaggatttgtctaatacggcgcaaaaaatctcgaggattatggaggagcacccaagcggaaagatcgggaaagaaattgccctcggcgttctggaccaaaacgagaaagtcatgatcgtttaccgcaaaaatgatatcttttatccgtccggttccaaatcatacaaagggatcccgtacgcgtcgattttaaaggacaagcagctgtcccaagtgtttagcgaaaagaagaaagtgagcaaagagttaaccccttctggcgggtcttcccgcaataagtaccatcatgtgattgtgacggccgtcccgcttcatgtgaagggggaagaaccgggcgcggtatttgtttaccagtcattggaagtgcttcaggaaatgacgcggcaaacgacaaaaatcattttgctcggtgcaggcattgccattattttaacgaccggctttgctttcttcctttcaaaaaggattggcgggccattgcataaaatgcgggaagcggcttttgaagtggcaaaagggcgttttgacaaaaaggtgccgattttaacccgtgatgaaatcggggaactggccaccgcttttaatacgatggggcgacagcttaaatttaatatggacgccttaaagcaggaaaaagagcagctgcggaatattttaagcagcatggccgacggtgttttgacctttaaccgggacggtgccattttaatcatgaacccgccggctgagatgtttcttcaaaactggtatcataaccaggctgcaaaagacgccccgcttcctgaagggttgtccgcattgcttgcgaaagtggtcgaaacggagaaagaacagacggatgaaattgaaatcaacggccggtactatgttatgattgcaagcccgctttataatttgtcccggatccgcggcgttgtcaccattatccgcgatatgacggaagaacggaagctggacaagctgcgcgatgattttatcgcaaacgtttcgcacgaattgcggacgccggttgccatgttgcagggatacagcgaagcgatcattgatgatattgcggcaagtgaagaagaaaagaaagaatttgccaaaatcatttacgatgaaacgctaaggatcggccggcttgtcaatgagctgctcgatctggcaagaatggaagcagggcatttttcgttcagaatggagccggtctcatttaacagtttcattgaaagagtgacacataaatttaacggcatcgcgaaagaaaaaggaatcgacctcgtttgcgagacttcggacagcgatctcacccttgaaatcgatgccgacagaattgaacaggtgctgacgaatttaattgataacgccctccggcatacttccccgaacggttacgtcaaagtaaaagaggaagaagcacccggcggcgtatatgtacacgtcgaagacaacggatccggtataccggatgaggatttgccgtttgtatttgaacgcttttacaaagcggataaagcaaggacgcgcggcaaatcgggaacagggctgggccttgcgattgccaaaaacattgtcgaagggcatggtggccggatctttgtcaaaagcaaattaggggaagggaccaccttttcatttttccttccaaaaaaaggctgacctctgcgccgggtctgcctttttttgtatattttcccgttttttgcgcatcttagaagatggctttgcttgaaacggaattgaaaaaatgaaaatggggtggatcaattgccggcatacatcaaaatatgccttttcgtttcattgacagctgcatgcctggggtttgcctgttcggcaaatgacgtagccgcatccgggtcggttatccatgaagcgacaaaagactggatttttccggcggcagggacgatctccgacacatttaacacaagatacggcacacataaagggcttgatattgccggaagataccgcgcaaaagtattcagcgcccaagaaggtaccgttacccgttcctatctgtccgcatcctacggccatgttgtttttatccgccatccgtccggttatgaaacggtttacgcccatcttgccggaagggcagtgagagcggggcagcatgttgaaaaaggaaaggtggtcggctatatgggttcgaccggccattcaactggtatccatcttcattttgaagtgcataacgggccatggacgccggataagaaaaacgccattgacccgtttttgatcttcggaccaggcgcgccgggccagacggtttccgccaagacccatgatccttacggggtttttgctgcttccaccgtccctcagcctgcagcttacactgtgaaaaaaggcgacacgctctggaacattgccctccattttcatacgagcgtgggaaggctgaaaagctggaacaaattgcggtcggaccggattatggccggccaggtgctgaaaataaaaaatgaatgaaagtggtgcggaatgcttcacaaaatggcagccggcatgtataataagcttgtaatcaaaatttcatacgatttatcttcggggctgggtgagattcccgaccggcggtgataaggcagttgcctttcagtccgcgagccggatttccggcaggatttggtgaaattccaaaaccgacagtatagtctggatgggagaagataaaggttgccagtgtttaatgacgtattaaacgcttatttggactcgcctattacaaagcccccgacattttgtcaggggcttttcattttggtccgcggcacctttcttcctttgatgataaatcggtcacaaggagagaggaagtttaaatgaagaaatgggatgtaaagcaattcgttgcggtcgcgttgctcagtgctctggcttttatgctgatgtttattaaatttccggttccgccttttccatcgtttttaacagtggacttcagcgacattccggtattggtggcagcccttctttacgggccgatggcttctgttgtagcggaactaatcaaaaatatcctgaattatttatcactcggcagtgaagcaggggtaccgatcgggaatgtggcaaacttttttgcagggatgctgttcgtcctgccgacatatctcatttacaaacggatgcggacaaaaaaaggcatgactgtaggtctagtcactggcacggtatccatgtcggtatgtatgagcattttaaattatttcgtcattttaccggcttacctgtacttcatgaacttttcggtcgggaatgtaaaagcgtatattgtggcgggcgtgctgccttttaatcttgtgaaaggcctcatcgtgacggctttgtttatgctcatgtttacaaaaatgaaaaattggattgacaaagcatccgccattgggggaaaaagaatatgaaaaaaagcaggctcaaacggcctgctttttttcattcgtattttaacggatcgccatcaaaaggcttgtcggaaactttaatcgattctgtcgggcatccttcaaaggcatccatcaggtcatcttccaatatttccgggacttccgcagtgcctttattatcatccaaaatcacgaaagaaagcccttcatcgtcatagtcgaaaatatcaggagcgctggcggaacaagcgccgcaagcgatgcatgtatctttgtccacgattgtaaactttgccattttgattcctcctcgttgttcaatcatggcagaaaagaaaaacaggcagcctcgtcatgtgcacgaaggcatgccggtgtttctccttcattttaaaactctttttttcttatttcaatagcgggctggcggagttcgtgaaacctgtcgaatcaatgaaaaaaatggtaaacaaatcgcctgtttccatgttaaaatagaaccaacccccgatttttccttgcacttcccccttttttcagctaaagaacaggagaggattcagatgccttttttacaggctgtattgctggattgcttcagcaacctgaatggagaacgcaccccttatgctgtttttcatctattaaacggcaaaaaatcagcacagacgatccaggattcccattttttcaagattggcaggctctttcaaacgtttccatttatttcccgtgaggctttcacacgcgaagtagaggccctattaaaagccgggttgctgcaaaaaagcggcccggatgcctgcgtggtcacagaaaaaggtgctgccctgcttttggcaaccggcaggatggaagaacggtttccttacctggacggcttgaaataccaggattcggcaaatctgttttggaaaaggttgaatctcattacccaggccgtatccaacttagtgtatggaaataaagtatattatccggttcaaagggacccggctcttcaggcttgggcaaaaaactggctgaaacagcatgcaaaaagcaggattgcgttagcggagcatctgtaccgtgaattttacagcctgttttccggcagcccgccggaaaagcctgaaatttttgtccttcggttgacgggtgcgggccggatcggatatacgatcacgcaggctgcctccgccctgcaccttgatcctgtagagtactggtaccgatttttgcatttgcttcattttatcgtccggcgcatccttggagatcctgaaacattccggtatttataccaaatgcttcacgatgtgcaaaaggccttgccactgacccggtctgccgcggtgacattcggcttcttgaagcaagggaaaacgattgcggaaatcagcacgctgagagggttaaaacaaagcacgattgaagaccatttgattgaaatcgcgttaacggtcccggattttccactgaaccggtatgtgccaaaggatgaagaacaaaagatcatccaggcagccgctgatttaaatacgaagaaattaaaaccgattaaagaaaaagtaggggacatcccgtatttccatattcgccttgtattggcagaaaggatgggccgcagtggatcttttaagttttttgaaaagtaagttcgggttcagcgcattccggccggggcaggaagaagtcatccgttcactgctggacggcaaagatacactggcgatgcttgcgaccggtaccggaaaatctttatgctaccagttgcctgcctatttgctggacgggtcctgcatcatcgtttccccgcttttatcgctcatgcaggaccagacagagcagatgaaaatgcgcggcgaaaaaagtgtggttgcgttaaattcgtttttaaccggtccggagcgggaagcggcccttgcacatctgggcgctttcaaattcatctttgtctcgccggagatgctgcacaaccgctatgtcctcggaaaattaaaaaccatccggactgcgctctttgcagtcgatgaagcgcattgtatttcccagtggggtcatgatttcaggccggaatacttaaaccttggcgaagtccggaaacaattgggcacaccgcttaccctagctctgaccgccacagcaacagaacaggtgagggacgatatttgcaagtatcttggcttaaaagacccaaaccggtttatttattctgtcaacaggcccaatatcgccattaaaatagaccggattccttcataccgcgaaaaagaggaaaaactagttgcctatgcgaaaaacttgcagaagcccggcatcatctatttttcaagcaaaaaggcggctgaggaaatggcggcgcggttaaggcaggagggaatcgccgaagcggccgcctatcacagcggcatcgaccaggagcaaagaattttgatccagcagcagtttatttacggacagatcaagatcatttgtgcgacaagcgcgtttggcatgggggtggacaaagcagatatccgctttgtcatccattttcacctgccgttgcagatggaagcctatctgcaggaaatcggcagagccgggcgggacgggcttccgagcattgccgtccttttgtatacggaaggggatgaacggctcccgcttcagctgatcgaggctgagcttccgactgatgcacaattggccgctttcagcagatggaaaggagatttgaaggaagccggggcggcgcttggatgcacggaaccgcaactccggtttctgctgcaccacagagtgcttaacctgccggaagaagcatggacccgggaggttgcagccatccggaacgagcggatggcgtacaagcgccggaagttaaaggaaatggtgcagatggtccggtcttcgtcatgccgccgctcggaaattttacggtatttcggtgaaccgcccgctgctggcaatgaagcgtgctgtgacatttgcggccttgaaacagccttatatgaaagcaatcaaaaaagcgggggcaccctcgaaaccgttcctgcatgggaattgcttttgcaggacctattcagaaaaggggaacaaaaatggcacgaagaaaacaggcggatttgatcaaggaactcacagaccgggaacttacttttcacttaattttgacacagctgattctcctgtttgctgccgctttgctcggatttctgttatttccggatggcaaagcattttttcagcactttcgtatgtcatttgcgaaatgtgcatacggtttattaaacggagttgctgtcgtttttgcggatactttgctcatgaaatggctcccgaaagcgtattatgatgacgggggcgtgaatgagcggatttttaaaacccgttcggttccgtctattattgctttaacggcgctgatcgcggtggcggaagagctcttgtttcggggcgccatccagacgcattttggattgccggcagcaagccttatttttgcactcatgcatatccggtattttggccactggtatttaatcgcgaatgtgctgcttttgagtttttggattggtgccgtttatgtgctttctcatgaaaatcttccggcggtcatcatcatgcattttacaatcgattgtttactaggtatccgcatcaaaaaacaggggatttagtccggatgtggggaaggggaagccatgtcagacgaaaaatatatcattgaaatggaaaaacggcggcaaaagcttgaaccggccggcaaagcaaaggaaaaaacggagaaacaaacggcggcggccgtttcgcgggcagaaaagcggaaaagtaccgaaaaggaatcccgctcccggttgccgcttgtgaacctattggctgtcatttttattttagtgccaattgccgtttacatctgttatacgtttttgtttttcagatagatgcccatcccgcgataaatggcgccccaaaaagaggagaatctgccggcgaaatttcaggacagggcagctgcctgcttgtcatggatctgtcccttgccgcatatagtagagtgagggagggatcaatatggagccgtccatcaccgggctaaaagggacagatgcggcgacaaagcagatgttacagggtgtcgtcaaacgcaaaaaaaaatttgaccggcttcggatgcggcatcttgtttttctttggacaagcatgctctacacatgcgcatgggcttactatgtttaccgttcttttgaaaatgccgattccatgttctccgttttctccggcatttcagaaagcccgtttcagctgtttttcctgctcttggccgccgcgttttggggcatgagtaaaatcttgtttgacaagcgggaaaaggctgaaaaagaattccatgcgctccgctgcgaaattattgataaaagcaaagatttatggaaaggggaaagctggaaggatcgccaccttgtattcgaaatgatgcaaaaagagtttgatattaatttataccacgagaacaagtagccattcaccggaacaggtacggagactaaaagccgccgaaaaaaagaagatgccccggcatcttctaaaaaattttttttctgtctctttcttccattaaaatttgcgcggcttcgcggaaccgctgcgagtggacaatctcccgctcccttaaaaagcggagcccgtcatttaggtcagggtcgtcacttaaattgatgatccattgatacgtagcccgcgctttttcctcggcggcaatgtcttcataaatatcggcaatcggatccccttttgcctggatataggtagctgtccacggggctcctgcggcattatgataatggagcgctttatcatggtccacataatgcgcgtcaaggccggcagcaatcaattgatccggtgtggcatcttttgttaattttaagaccatcgtcgcaatcatttcaagatgggccagttcttccgtgccgatatcatttaaaagccccatcactttatctgggatggtgtagcgctggttcaaataccggagcgctgccgcaagctctccgtccgctccgccgtactgctcgattaaaagtttcgcaagtctcgggttacagcttgagacccggacgggatattgcaattttttctcatagatccacatgtacggtttcctcctttatttgcttatacctgccatggccacggcggctctttccactggaaaggcgttggcgaatagctgtgcccgaaatttgtcagcggcccgaactgtttttcaaatgctcttttgacttttttcctggcatggacaaaagtgttatactgttcgatcgctgcctggtcatcgggatgggtatccaaataaaggttcagttccacaagtgcaaaatcaagggcctgcagttcttcaagccttgtgtaatactcttttggcagctgcttcaatcgttttcctcctttgcccgttcataagggctgtaatacgggtcataaagcggcctccaaagcgtcccgcgccttaacgcttcctgcggtgcaaattgcggaaggttcgggggctgaaaccctaaatacaaattcggcggggtggagtaaactttttcggttatcggcgggcaggggtcaaacggtccgataaagggatgatacgttttataatggtttttcatctcagtcctcctgacatttaaaagtctttttcattttatgtgcggttctctcccgctatgtcaaaaacaatgccggaatgctttctatctgccatgattaagatataatacggatagggattgcagaaaatttcgtttgtgccggccagcacccggcggaacaggagcactcgtgtatgtttgcatttttatcgattgcctttttgcttggcattgttttattgatgtatatgcattatgaagcatcgttaaatcggctcatccggcaccggtttttgcttgatgagtatccggccggagaggagccgtgcacttttttctttatttctgatatccaccggcgcaaaattgatcccaggctggtcgaagaggcaacaggagaagcacgatttgcaataatcgggggagatttgctggaaaagggggttccgctttccagaacagaggaaaatttgcggttgctgaaaaaaattggcccggtattttttgtgtggggaaataatgattatgaagcggacggcgaagcgctcgcgaccgtttttgccagaaccggcgtccgcacgctgcgcaacgcggcggattttgtatatgtaaacgggaaaaaacgaattgcgctgatcggcgtggatgatttgacgacggaaaacgaaaatctcgatgaagcacttcaatcggtgcagccggacgatctccggattttaatcagccataacccgaaaatgatccaccagcttcatgaatgggacaatatcgatgtgatgctgagcggccatacgcacggcgggcagattcgtattctcggccttagccgttacaggcgcggcggggtgagaaaagtgcgcaatgtcatccacctcataagcaacggttacggcacgacacttgttccactcaggctttgtgcaaaaccggaagcccatttaattacgatcgaaagcagcaggcggccatcatgaaccatctttccccttccgcatacgataaggtaagatccgtatgcagggggcggaaatcaatgaagctggaacggatttcatccaataaaattaaatactccattacgtttgaagagttatcggaacgcggtattatggaaaacgatctcgactcgcccatttggaatcatttatttgaagaaatgctggagttggcggatcaggcttaccatgtcggcgaaagcgatatgctgaccattgaaatctattcatttaatgtccaggaattggtgtttattctgacagtgggcgaagcggacgacgcggatccgggcgaatgggcggatccggaaacgctggaacaggaagaagcctacttttttccatcgattgaggaagtgattgcgcttgcgggctttttaaaccagatcggccggatttccgcgtgcagcctttatatattcgaagaccagtattatttgctgcaaaaaccgggaacacaaaatgcgccgcttattcttgaatacggcgagcgcgcccggatttccccgtttatggtccgggaatacgggatcgcggtgtttgaggaaaatgcgcttgcggaactcctgaagcatttcccgtaaccgtccgccatgttttttcaggttttcatctgctggggaaagttgtatactaaatttgatagcagatatttctttcgtatctaggaggtttgcgataatggcagccgaaaagggcgcagatcatcaaacaatggaagcaagtcgagatgtgctgaaatcgacacagacaattattcacgaagctcttgaaaagcttggataccctgaagaagtatacgaacttttaaaagagccggtccgtatgttaacggttaaaattcccgtcagaatggatgatggtacggttaagatttttacggggtaccgcgcgcagcacaatgatgctgtcggcccgacaaaaggaggcgtccggtttcatccggatgtgacggaaaatgaagtgaaagccttgtctatatggatgacgctaaaatgcggcattgtgaatctgccgtatgggggaggaaaaggcggcatcatctgcgatccgcggaaaatgtctttccgcgagctcgagaatttgagccgcggctatgtccgggcgatcagccagattgtcggtccgacgaaagacattccggcaccggacgtgtttacaaattcgcaaataatggcctggatgatggatgaatacagccggatcgacgaatttaattcgccgggctttatcacaggaaaaccgcttgtgcttggcggttcgcacggccgcgaatccgctacggccaaaggggtaaccatctgcattcgcgaggcggccagaaaaaaagggattgatttaaaaggcgccagggttgtcattcaggggttcggcaatgccggaagtttccttgcaaaatttatgcatgatgcgggcgcaaaagtgattggcatatccgacgcatacggcgcgctgcatgatccggaaggccttgatattgactatttgctcgaccgccgcgacagtttcgggacggttacaaccctgtttaaaaatacgattacgaacaaggaattgcttgaactggattgcgatattctcgttccggccgccattgaaaaccaaattacagaagaaaacgcccataatatccgggcgaaaattgtggtggaagcagcaaacggcccgacaacgcttgaagcaaccgaaattttaaccaaccgcggcattctgctcgttccggatgtgcttgcatctgccgggggcgtcacggtttcgtattttgaatgggtacagaataaccaggggtattactggacggaggaagaagtggaagaaaaacttgaaaaagtgcttgtccagtcgtttaatacggtctacaatacttcccgctcacgccgggtgaacatgcggcttgccgcttatatgatcggtgtaagaagagtggcggaagcttcgcggttcagaggctggatttagagtttccgaaagccggctccagccgggcggcaaacggggctttacaggttttagaagaagaaggctgaaatctcctgtcgtgttcacggtgggagatttttaaataaatggatgaaaacgaaaaggaagatacgaaaaaaggatgagtggacaaacatgcgaaaagaagattgtatcattattggcggcggcccttgcggattggctgctgcaatcagcctgcaggaaatcgggaaacatccgcttatactggaaaaaggaaatgtcgtcaatgcgatttaccgttatccgacgcaccagacttttttcagttcaagcgaccggcttgcaatcggcgatgtgccgtttattaccgaaaatttaaagccgaagcgcaaccaggcgcttacatactaccgcgaagtggcgaaactgaaggcccttcgcatccaccggtttgaagaagcgctccgtgtcgaaaagaaacgcggaacctttatcgttacgacgacaaaaggccaatatgagacgccttatgtggtcatcgcaaccggctattacgacaatccgaacaggctggatgtcccgggggaagatttaaacaaagtgtaccattattttaaagaagcccatccgttttttgacaccgatgtttgcgtgatcggcggaaaaaactctgctgtggacgccgccattgaacttcacaaggcgggcgcccgcgtgaccgtgctgtaccgcggcgatcattattccgaaagcattaaaccgtggatattgccggaatttgattcgcttatccgccacgggaaagtgaaaatggaatttcaggcgcacgtgaaagaaattaaagaacagagcgttgtatacgaagcgggcggagaagtgaaagagatccggaatgattttgtatttgcgatggtcggttatcatccggatcattcgtttttgcggaaaatgggagtgggcgtcgatccggaaacaggccgcccacattacaaagaagagacaatggaaacgaatgttgaaggaatttttattgcgggcgtgcttgctgctggaaacaatgccaatgagatttttattgaaaacgggcgtttccatggcggtgtgattgccgctgagatcaaaaaacgggaggctctcttgcaaaaaggaaattaaaggttttttcgggggggcagtatttcttttccggctttttcatgttacgatgaaaacaaaactctgcacggatcatttgatttttacaaaaagcgaggtttcgatatgcttgtccttttgtcagccggcatcgcccccggacttgccctgctatgctatttttatttgcgggaccagtttgagcctgagccgatacttgttgttgcaaaagcgtttttatacggtgcgcttatcacgctgccggtcatgtttttgcagtttatcctcgaacgggagcatctcttttcgggcagcatctggcatgctttcctccattccgctttgccggaggaactttgcaagtggctgtgtttggccgctattgtgttttttaaccgggaatttgatgaaccttttgacggcatcgtttacggcgtcagcgtctcgctcggatttgccacgctcgaaaatattttatcgcttttttcgggcggcgttgacctggcgttcgggcgtgcgcttcttcctgtatcaagccatgccattttcggtgtcatgatgggcttttatatgggaaaatccagattctccccgcgcaaaaagtgctggttccttttttcttttatggtgccggtgatcctgcacggtttttacgactggatcatgctcacccagcaaaaatggctgtattttatggtaccgtttatgctcgggctttggtggctcggcctgaaaaaagcaaagcaggcgcacagcctttctgccaaacattttgcgcaggatgcggcagggacacaacaattatgataatgggcaaaacaaccggatcaatcgccggttgtttttttatgtcttgcataaaattgccgccttctccagaaactacggataatgcttaaagtttttggggggtgcggtatgattggaaaaaatcgcttaaaatacatgttgctgctttgtgccgtattggccttgttttcttttggcacaagcgggacggcccgggcgttttcgaatcaggtgattcaaaaaggagcggtcggggatgatgtgattgaactgcaggcgaggctgcagtacatcggttactataaaggaacgattgacggggtgtttggttacagcacttactgggctttaagaaatttccagaaggcatacggaatgcctgttgacggcctcgccggcccgggcgtcaaagcgaaactcgtcaaagcgtcaaaatacgatgcggcatacgtaaagtccatggttgcaagcgggaaaaaattcacgtattacggcggcacaaaaaagcaggcaccgaaaacggcagccaaaaaacccgtccaaaccgctaccaatgtgccgaacggattttcgcaaaacgatattcgccttttgtcgcaagcggtttacggggaggcgcgcggcgaaccgtatgaagggcaggtggccgtggcggctgttattttaaaccgtattgacagcccgtcttttccaaacaccatctcgggggtgattttcgaaccgggtgcgtttacctgtgtttccgacgggcagatctggcttgcgccgaatgatacggcaaaaaaagccgtcctcgatgcgatcaatggctgggatccgtccggtaatgcgctgtattattttaatccggcgaccgcaacaagcaagtggatctggtcaaggccgcaaatcaaacgaatcggcaaacatattttttgtaaataagagggggaaatgaatatgctgaaacgggcaatgattgttgtgcttgccctcgggctttgcgggactgctgcctgggcatataaagagcaccgtgaaaaagaggcggtcttgttaaatgcagaaagcacgtatcaaagggcttttcatgaccttgcatacagaatggaccttttgcatgatgaaatcggaaacaccctcgccatgaactcacgcaagtccctttcaccggcactggctgaagtatggcgcctgacatcagaagcgcatgcggatgtcggccaacttccgttatcgcttctgccttttcataaaacggaagaatttctgactaatatcgggaatttcagctaccggacggcggtgcgcgatttggataaagaacctctatccgataaagagtatgcttcactgaaaaaactgtacggccagagcgcggatatccaggaccagctccggggcgtgcaaaataatgttttaaagcacaatctccgctggatggacgtggaacgcgcccttgcccaaggaaaagaaacgaaggataacacgatcatcgacggctttaagacggtcgaaaggacggtcaaaggctatgacaatgccgatttgaacagcccgtcttttacgagtttccaaaaccgcgatgaccattatgagcacctggaaggaaaaatgatcagcaaaaaacaggcggtcgccactgtaaaacaatacgccggactcaaaacggcccgccaggcggaagccaaaccgaatcaaaaaggcgcccgtttttctttttacaccgtccgtataaaagacaaaaacggcaatgaaacaaccgcagatgtgacgcggaaagggggatacccggtctggtttttcaacaagcgtccggtgggaaagcaaaaaatcagtttaaacgaggcccaaaagaaagcggcggattttttaaaccggcaccattttgagaaaatggacatgtttgaaagcacacaatatgacaacgtcggtgttttttctttcgctgcgaaacaggggaatgtccgcatttatccggaaacggtcaaattaaaagtggcgcttgacaacggccaggtgatcgggtttgtagcggatgattttctgaaaagccatcaaaaaagggatattccaaagcccgccatcagcgaaaaagaagcaaggtcccgtgtgaatccgaagcttgacattatggaaagccgccttgcgatcatgaccggcgacatgaaccgggaagtgctttgttatgaatttctcggcgtgttgcatgatgaaacgtaccggatttatatcaacgcggaaaacggcaacgaagaaaaagtggaaaagctgaaaaacacggaaagagcatacggcaagtccatatgagcattgcccggcgtacagccgggccttttggcaaaaaatgaaatgaaacgcgaaaaaagaatacaaaactgcccagcctgtgtcataataagattggaatctataaaaggggtttgggaagatgttaaaagtcgggctggaactcacactggaagataaagatacaggtaaaagatatagatgtaaaattgcggatataaaagaggataaaatttatattgattacccgatcgacatggaaacaaaccggaccgtatttttgctgctcggccaggggctgctcgttgatttcgtttcggacggccagattccttaccggttttcatcaaaagtaaccggcagggaactcggcaatatcccgatgctcattttatccgctcctgatccggaagatgtgcgcaaaatccagcgacggcagtatgtcagggtagacgccgcactcgatattgccctcacctttccggaatccaatttgaaaacaacggcagttacaaaagacatcagttcgggcggctgtgcggtctatttgcctgatgatatccgcccaagggagcatgaaacaggaaaagcgcttcttgtcctgccgctaaaagaaggttaccaatacttacagctgcatttttccgtcgttaggctgtttgaaaccggcggaaaaacaggggcctcgctccagtttaaaaatacaagcgcgaaagagaggcagtatatcctgcgtttttgcttcgagcagcagcttttgctccgtaaaaaggggctttccggataaaacttgcatttcatggataggaggattcaccattttatggtacactataaaaagggtgtatccttttatctgcccaaaaaacgggtatatgcaacaagagagaatagggtgaaatcgttgtatgaaaaaaatcaatattgccatcgacggtcctgctgctgcagggaaaagcacggcggcgaaaaaagttgccgagcagttgcaatatatttacattgatacaggggcaatgtaccggtcgcttacttataaagcgctgcagtacggaacggaccttgaagacggcaatgcgcttgccgaacttttgtacaagacaaatatccgcctggagccgggggaaaacggccaggtcgtttttgtcgacggtgaagacgtaaccggcaagatcagggaaagggaagtgacgagagcagtttcggctgtttcaaagcatgccgttgtccgtgaagaaatggtcaagcggcagcggatgctcgcccgcggtggcggcgttgtcatggacggccgggatatcgggacaaaagtactgccggatgccgaattgaaaatttttttgctagccagcgccgatgagcgcgcaaagcggcgccatgccgaaaatgttgcaaaagggatcccttcagacctcagccgtttaaaacaggagattgaggaaagggacaggctggattccgaacgggaagtttcaccgctctctaaagcggcggacgccgtagaactggacacgacaagcatggatattgatgaagttgccggaaagattcttgcgatggcaaaagaaaaaatggcacagcagcaatcggcttctttacttgacaaaaagtaaaagatgttagaaatttgataggaaagcgtttctttttgaattatacgaattaatttgaaaagaacgggtatattcaatggtagttgaagcgccggataaggaggaagtacatatgtcagacgaaatgaatgaaatagaagtacggtccctttctgtaggggataaagtgaaagcatcggttgtcaaagtggaggaaaagcaagtgctcgtttccattgaaggcagcaaagtggacgggattattccgatcagcgagctttccaatctccatattgaaaccgcatcagatgccgtgaaagaaggggacgagctgaatctcgtcgttacgaaagtggaagaagacgccgtcattctttccaaacggaaatatgatgctgaaaaagcctgggatgagctgaaggaaaaatttgaaaaccaggaaatcattgaagcggaagtcaatgaagtggtaaaaggcggccttgttgtcgatttgggtgtccgcggctttgttcctgcgtcccttgtcgaggaccactttgttgaagacttctccgactataaagggaagacattgccctttttgatcgttgaactggacgaagacaaaaaccggttgattttatcacaccgagctgttgtggaaaaagaaaaagaagaaaaacgccaggatatccttgaccatctcgaagcaggccaggtgctggaagggaccgtgcaaaggctgacgagtttcggcgcttttgtcgatatcggcggaattgacggccttgtccatatttcccagcttgcgcacgaacgggtggaaacgccgtccgatgtcgtccaagaaggagagcaagtcaaagtgaaagtgttgtcggtggaccgggacaacgggcggatttccttgtccatcaaggatacgcttccgggcccttgggaaggcattgaacagaaagcgccgaaagggactgtccttacaggaacggtaaaacgcctagtttcgttcggggcgtttgtagaagtattcccgggcgttgaagggcttgttcatatttcacaaatttcccataagcatgtgtccaccccgcatgaagtgttaagggaaggacaggaagtgcaggtgaaagtgctcgatgtcaacgaacaggcacaccgcttgtccttaagcatgaaagaactggaacaggccgatacagaagcttctgattatgacctgcctgaagaaaataccgggttccagctcggggatatgattggggaccagttgaagaaatttaaacagtaaaaatgtccggatggaatggaaaagctgagcggcgcccgggttgccggtgccgctcagcttttttgcgctttgtcttttctataaaccgttttctttactgccgtttgcgtgctgcgtcagcgctttcgaggcgggttgcccctccgtaatggagcgcttggtcacggtcgctttctacacgcccgctttggcgcagttttttctcctggcggtcttttcccattgcccattcacccccgcttgtagtatgcctgaaaaaagcgaaaaacttgcggttaacccggtgcaatctttcccataatggagataaaggagggtgcaccgtggaaggagcattttttttgggggtgatgtgggcggtatggatttgggcgacatttttgctggaaagggatcaccctttgcggtttccggcagcactggttgctttgctgcttttgattgcctttccgcatcaagcggcggtgggccgtcttgatatgagctgggcgctcatcgtcattatggctgccggttatgggtacttcggcagattttcgaaatgggcacttttggtccggctcgccggcgtcttcatcgtgatgacaggttatgcaggcctgttgttatttgaactgtacgatccggtctggatgtttgcctggcgtactatttgctatagcctgtttttgtttatccttgtccatttgctttttcgctcaaaaatggatgctgttgccgctgcactcaccggtacggcacaaggggaaatcctgtatgcgctcgtgcttgcaaaatgggatttccatattacggcaggatctgcggcatatctcgatatcgccgggctttttctcctctacgcgtgcggctggcatttcatcgataccgccttgaatctcatctcagaaagagcggcaaaaaaggaaaagccaggatgaattacggcatattgcttgaacaagaaaatattgataaactactaaagttgatttgttttgcgaaaacggaacagaaagggtgaatcgtatggcaaaaccggttgtggcaattgtcggacgcccgaatgtaggcaaatctaccatttttaaccgaattgtaggagagcgcgtttcgattgtggaagatgttccgggagtgacaagggaccgcatatacagtccggctgaatggctgacacacgaatttaacgtgattgatacaggcggcattgatatcggggatgaaccgttcctcgagcagatccggcagcaggctgaaatcgccatccaggaagcggatgtgatcatttttatcacaagcggcagagaaggcgtgacttctgcggatgaaatggtcgccaaaatattgtaccggtcaaaaaagccggtcgttctggcagtgaacaaggtcgacaatcccgagatgcgcacccagatttatgatttttacgccctcggttttggcgatcctttcccgatatcaggcgcacacggcctcggccttggcgacctgctcgatgcagttgtcaaacattttccggaaaaagcggacgaggagtacggggaagatgtcattaaattttgtttcatcgggaggccgaacgtcggaaaatcttcgctgtttaatgcgattctcggcgaagagcgcgtcattgttagcgacatagaagggacgacaagagacgcagtggataccgtctatacttatgaagatcaaacttatgttatgattgatacagcagggatgcgcaaaaaaggaaaagtgtatgaaaacacggaaaaatacagtgtgctgcgcgcattgagggcgattgagcgttccgatgtcgtctgtgtcgttttaaacggcgaggaagggatccgcgaacaggataagcggattgccggctacgcccatgaagcgggccgcggcgtgatcattgtcgtcaacaaatgggatgccgttcaaaaagatgaaaaaacgatgaatcagtttacacagaaaatccgggaccattttcagtttcttgattatgcgccggtcatttacgtatcggcaaaaacgaaaaagaggctggaccagctgttcccgctgcttaagacggtcagcgagaaccatgcgatgcgcgtgaagtccagcgtgctgaatgaagttataacggatgcggttgcgatgaatccgacgccgacggacaaagggcggcggctgaaaattttttatgcaacgcaagtctccgtcaaaccgccgacgatcgttgtgtttgtcaatgatcccgaattgatgcatttttcgtacgaacggtttttggaaaatcggatccgtgatgcgtttggttttaccggaacgccgatccacatcatcgcccgtgcgcgtaaataaacataaagagggtgtttcatttgtccaaaaaaacgattgcagtgctcggcgcggggagctggggcactgccttgtcgattgttttggctgataacggctttcaggtcaggttgtggggaaacaaaaaaggccagatcgatgaaatcaatacatcccatacaaacgcgttttatttgccgggcattcagctgcaatctgccattaccggcatcttttcacttgaagaagcgttagacgacattgataccgctgtactggcggtccctacaaaagcggtgcgtgatgtatgcaggcaagtaaaagcggtgcggaaaagcccgctttccatcatccatgtcacgaaagggattgaaccgggttccctgatgcgcatttcggaaatgattgaagaagaaatgccggaatcgttgctgcgggatctcacggttttatcggggccgagccatgctgaagaagtcagcctgcgccatccgacgaccgtaaccgtttcatcgaaaaaaatggcagctgccaaaaaagcgcaggacatttttatgaactcgaattttcgcgtctatacgaatcccgacatcattggcgtcgaattgggcggttccctgaaaaatattattgcgcttgcagccggcattttggacggcctcggctacggggacaatgcgaaagcggctttaatgacaagagggcttgcggaaatcgcccggctcggcactaaaatgggtgcaaatccgctcacttttctcgggcttgccggaattggcgacctgatcgtgacgtgtacgagtgtccactcgcggaactggcgggccggcaatatgctcggcaaaggcaaaaagctcgatgatgtgctggaacaaatgggaatggtcgtggaaggcgtccggacaacaaaggcggcttaccagctctccagccggtacgaagtgaaaatgccgattaccgatgccctttaccatgtcttatttgaaggacttgatccgaaagaagcagtcgacaatttaatgggccggctgaaaaaacatgaaatggaaggtttgatggatatgctgggggaacagtactaggcatcttggcaaaaaagtcccggtaggctttcggacgataccggatggatgcatgttgcataaactgcaaggaaaaagaattcgctttaaactgcgcaggctgggtatagtcaaccttttctccggggcagacgttcgccccggccttttttatgccgtaaattgaaacatttcaaaagcttatgatataatgtccgaagtccgaaaagtttacgaattttacaagggagaaaggggagatggttttgtcccgggggatggcgaatatgtggatttcgctttttggcatgggcctgctctgtttggcgatggtattgattgttgcaagccgatacaggctgaaacaaaaactgttcaaatgggcggctgctgtgattgcgtatgcctgcctggcgctgggcggcctgattatggcttatatcgtgctgagcgggccggcaaattaaccggagggggagatcgttttgcacttcaaaaatatgctgctattgcttgtagctgtttgcgcctgcatcagtttaggcggctgcctttatccgggggcacaggaaaaagaaagcgggctgccggatgacatgcagcttcaaatggtgcaaaaagctgtagatgaataccggaaagacaatagcggcctgcttccgatcaagacaaagccgcaaaatacgccggtctatttaaaatacccgattgatttcaacaagctgaaaagcccgaaaaactacctgcccgatccgccggcaaatgcgtatgacaacggcggcacgttgcaatatgtgctccttgatccggaacatcatccgacggtcaaagtgtttgatacgagaatacccgagaaaataagagacttgcaaatccggattgcgtcccagggctatccgccatttaaaaaagagattgcaagaaatgtatacgctttagattttaaaaagctcggttacaaaacagatccgtacgtggtgtctccgtataccggccggaaactgccgtttgtcattaccgggagaggcggcatttatgtcgattaccgggctgatctggcaaaagcgctcaaaacgggcaagcgggcgtttaaacccggggaagatatccgcgtgctgttaactgaaggctccccgtttgtaccggcttattcccttccctgcaccgtaaatcaaaaaaatgaaccggtatttatggcaaaatagtcataaccctttctcatcccaatatattgttagagaaagggtttattttttggtcctgcgtctcttcgtaaggaaaaattttgaaaaaataaacaggggcaaatcctgtacagcaactttttgaaaatctataaaaaatcattttatagacataaggcggtcggacaacatcatacacatataatgtcctatcatcagcgcgaatgatggtgtcccgggaacgaatgtggggagggaaacaaattggaaaaagttgatatttttaaagatattgcagaacgtacgggcggcgatatttatttgggggtcgtgggcgccgtcagaacggggaaatccacttttattaaaaaattcatggaactcgttgtgcttccgaacattacaaacgaagcggacagaaaccgggcgcaggatgaactcccgcaaagcgcggctgggagaacgattatgacgacagaaccgaaatttgtgccgaaccaggcggttgctgtccatgtcgacgaagggcttgatgtgaacatccggcttgtcgactgtgtcggctacacggttccgggcgcgaaaggatatgaagatgaaaacggcccgcgcatgatccatacgccgtggtatgaagaaccgatttctttccacgaagcggcggaaatcggcacgagaaaggtcattcaggaacattcaagcattggggttgtgatcacgacagacggcacgatcggcgaaattccgcgtgaggattacgtggaagcggaagaaagggttgttgccgagttaaaagaagtcggcaaaccgtttatcattgttgtcaattcggcaaagccgcatcattcggagacggaaatgctgagggcggaattgcaggaaaagtatgatcttccggtgctcgccatgtcagtggaaagcatgcgtgaagccgatgtgctgaatgtgctgcgggaagcgctgtacgaatttccggtactggaagtcaatgtgaacctgccgagctgggtcatggtgttaaaagaaaaccactggctgcgtgaaaattatcaggacgccgtgaaagagtcagtaaaagacattaagcggctacgcgatgtggaccgcgttgtccaggcttttaacgaatatgaatttattgaatctgcaagccttgctggcattgaaatggggcaaggggtggcggaaatcgacctcgaggcgccggatgaactgtacgaccaggtcttaaaggaaatcgtcggcgttgaaatccgcggcaaggatcatctgctcgagctgatgcaggatttcgcccatgcaaaatcggaatacgaccaaatttccgatgccctgaaaatggtgaaacaaaccggctacgggattgcctcaccttccctgcaggatatgagcctggatgagccggaaatcatccgccaaggatcccgtttcggcgtccggctgaaggcagtggcgccgtccatccatatgatcaaagtcgatgtcgaatcggaatttgccccgatcatcgggacggaaaagcagagcgaggagcttgtgcggtacctgatgcaggattttgaagatgacccgctgtccatctggaattcggatattttcgggcgcaacttaagttccattgtcagggaaggcatccaggcaaaattatcgcttatgccggaaaatgcccgctataagttaaaagaaacgctcgaacggatcattaacgaagggtcaggcggcctgatcgccattattttgtaagagggataccgcggtatcccttttttgtatacgtgggacgagcatctttggccgcaagttagaattttttcgggaaaagtactttaaatccgaaaaaaattgaaaagttttcctttgttagcgaatagttcttgcacctctcttgcgattatgataatcttttaacagaattggtgctgaaaagcctgattccatccggttttaaacgtttatgatgagggaaaaccgtatacactgaagagaagaaactggaaatgacttctacgtttcttttggaggaggtgaatggaatgaataaaacggatttaatcaatgcagtggcagaagctaccgaactttccaaaaaagatacgacaaaagcagttgacgctatttttgatacaattcaaaatgcattggcaaacggagataaagtccaactgattgggtttggtaatttcgaagtgcgcgaacgcgctgcccgtaaaggaagaaacccgcaaaccggcgaggaaatcgacattgcggcaagcaaagtgcctgcattcaagccggggaaagcgcttaaagacgcagtgaagtaattacatatggttggctttgagcggaaaaaaggctgcctgggcagcctttttttttaatacagcagggcccaaaaaagggaaacgcgcatacgtttggcacccgttttcccggggcaaatgcctgcgaaatcccggtacagccggggaaagcctgagcgcggcgtttccggcgctttgactgcaaacggcgctgtggtaagatgaatatatgaaaagttttttaaacgaataaaaaggaggcccgaaaatgaaagcagaggcgcaggcggattatatcgtcgtgaaagcgttgcaggacggggtgagcgtcattgggctgtcaaggggtaccgatacgaagctgaaccatacggaaatgctggatgatggcgaagtgctggtcgcacagtttaccgaacatacttccatgatcaagattcgcggtgaagcgcaaatcatgaccggcatcgggagtttgcaaagcgaagcgaaaaaataaaccgaaatcaatttgttaacggccgttttacatatgtgatataataaactacagcttatttttaggccagatcaacgaagaaacggggaaagggttatgtcataccagagggagcagcaaattgccgcaatcaaacaggcgattgaagaagaagtggcacacgactatttaaatcagtttattgacgccccatacatagatgaagaccggatcctgcttttgataagcagccttgcggggcagccgtatacggaacatgaagtaaagcagtttgttgcgactgccatgctgatccagattgcccttgacacccatgaaaaagtaaccaatgcaaaagaaaatcaaaaaagccgccagcttaccgttctggcgggggattatttcagcagcctttactacaaactgcttgcgggcgtgcacaacgtccggcttgtcggcatactggcggaaggaatcaaatccgtaaatgaatataaagtgatgctttaccaatttgacaattccgacgcggagacgttcgtcgggcatttgaaaaaaaccgaatccgcgattattacaaaatttatgcagtttttcggttcacagccgctcatccgcttaagcgaggaactgcttttgtttaaccggctgttaagggaaaaggagcaggccgaaaacgggaagcgctccatcctgtttgaagccctgaacaaaatggcctacccgggtgacgggcgcccttttgagcagctgccgcatgagaaaaagcgaaaactgttttatatttgtgagaagtatttgaaagaaagcatccgtgcgttgcaggctgcggccatgtcatgcggaaatgaaatgctttcagagcggatccgcctgctgatggggcggtatggcgatgcaacgagattatatgcggaggaagggtaaccatgatgccaaaagaagagcgggtacacgccgttttcgaaaaaatttcgcaaaactacgacaggatgaactcggtgatcagcttcagccagcataaacggtggcggaaagacctgatgcggaaaatggcggtaagagaagggagcaacgcactcgatctgtgctgcgggacggcggactggacgattgccctcgcacaggcagtgggcgaatccggcagtgtgacagggctcgatttcagtgaaagcatgcttgaagtcgggaagcggaaagtggacacgcttggcttaaaaaatgtcgcgctccgttacggaaatgcaatggaactgccatttgaagatgcaacgtttgattatgtgacggtcgggttcggactcaggaatgtcccggactacaaacaggttttgcaggaaatgtacagggtgctgaagcccggcggcatggcggcctgcctggaaacctcccagccggtgattcccgggtacaggcagctttattacttttatttccgccggatcatgccgcttctcggacaatggctcgcaaaaagctaccgggaatattcctggcttcaggaatcggcactgcagtttccgggaatggaagaactggcggctgctttttccgatgcgggttttggccggattttgtacaagccgtttgccggcggggccgcagctgcacatattgccttgaaagagaaatgatgatcggatggagacggaatgaaggtacaaatgctgtactcgtttttaaaaacggatattgagcttattgaacaagagctggccaacgctgtcgcatcaaacgctgctttgatacagcaggcatctgaaagtttgctgaaagcgggaggaaaaaggatccgccccgtatttgtactgctcggcgcgaaattcggagattacgaaatcgaacgtgtcaaaaatgtcgctgttgcactggaattgatccatatggcatcgctcgtgcacgatgatgtcattgatgatgccgaattgcgccggggaaaaccgaccgtaaaagccaaatgggacaaccggattgccatgtatacaggcgattatattctcgcaaccgcgcttgaatatattacaaaagtggaggatctctccgcccaccaaattctggcggatacacttgttgaagtgtgcgtcggcgaaattgagcaaattaaggataaataccggtttcatcaaaatttgcgctgttacttaaggcggatcaagcggaaaacggcgttgctgattgcagctagctgccagctcggggcgattgcatcgggcgccgacgaaaacatccaccgccaattgtaccggtttggctacaatgtcgggatgagctatcaaattattgatgatatcctggattttaccggcacggagaagcagcttggaaaaccggcaggcgaagatttgcgccagggcaatgtaacgcttccggtgctttttgcaagggaagacccaaaaatcagaaaaaagctggaatatgtccatgagcacatgccaaaagcggagcttgaagacgttgtcagactggtcaaacagtccggcgcgatcgaacggtcttatgcagtgagcaactgctatctagagaaagcgctcggtacgcttgagcagcttccggatacccgttttaaaaaaatgctggcagatttggcgcgttatatgggaaaaagaaagttttaaaagaaagcagggctgccgggcagtgccctgcgttggcggcccggttttgaagcgcttacttcaaacatattgagattttcccgccaccatggtacgattttctatggccaagatgtcttacatagtagaaatgcgaatggagtggatgaagatggaaaggacttttttaatggtaaaaccggatggggtcagccgccagctgatcggcgaaatcgtttcccgctttgaaaagaaagggtttcggcttgcgggggcaaaattgatgcaaatttcggatgaacttgcaaaaaagcattacgctgagcataaagaacgcccttttttcaatgatctcgtggcatttattacttccggtccggtctttgccatggtttgggaaggcgaaaacatcatcgctaccgcacggcaaatgatgggcaaaacgaatccggccgaagccgccccggggacgatccgcggcgattacggcgtgattgtcagcaaaaacattattcacggttccgactcaccagaaagcgcgaaacgtgaaatttccctgtttttccgggaagatgagctgatctcatacagtcggccggcggatgcttcgatttattaaatcatgcaaaaaaagattggcgatcctctccgcgccaatctttttttatgttaaaataaacggtatgaaccaacaaatctgaataaaaatacggggattgcataatgaaaacagaactggatgattacggccggttcattgcgcaagtcaaaaagaaaacggggatcgatttatctttgtataaagaagcgcaaatgaaaagaaggctgacgacattatatgaaaaaagaggtttttcatctttcagtgaattttttcacggattggacaaaaacgaacatttgctggaagaatttttggacagaatgacgattaatgtttcagaattttatagaaataagtcaagatgggatgtgctcgaacggaacattttgcccgggctgctgaaagaaaaaggagaaaaactgaaaatctggagtgccgcttcttctacgggcgaagaaccgtatacgatggcgatgatcttgtccaagtatttaccgcttaataagattcagatcctggcgaccgatattgatcaaaaagccctgcagaaagcagaagccggcgtttattccgaacgttccatcctggaagtgccgcgcgaaatgaaacaaaaatattttcaaaaaagcagcggaggtccgttctatcgaattgcggacgaaatcaggcgggcggtggtgttcaaacaacataatttgctgcacgacccttatccggcagcggatctgattatttgccggaacgtgctgatttattttacagaagaagccaaagtgtctgtttaccggaatttcagcaaaacgctgtcggcaaacggcatattatttgtcggcagcacggagcagattttcaatccggctgcgtatggatttgaaattgtagacacctttttctatagaaaaatataaagtgctccatctattcgatttatagcgattgtggtatagtaatagatatgtaatgctttaaagtgatgaagggggatgcagaatgagatatttgacagcaggcgagtcgcacggcccggcgctgaccaccattattgaaggccttccagcgggcatgccgctgacagctgaagaaattaacactgaccttgccagaaggcagaaaggttacggccggggacggagaatgcagatagaaaaggacagggcaatcatttctgccggcgttcgccacggattgacgctcggttcgccggttgcgctcacggttgaaaacagggactgggtgcactggaataagatcatgggcattgagccccttccagatgatgcggacgatgtgaaacggcgtgtgacccgtccgcgcccggggcatgccgatcttgccggcgggatcaaatacgggcacagggatttgcgcaatgtgctcgagcgctcttccgcacgcgagaccaccgttcgtgtggccgctggggctgtcgcgaaaaaactgctgaaagagcttggcattgaagtggcctcgcacgtgcttgaaatcgggggtgtacgcgcggaaaaggtgccatatgattcccttgcttccttgcaggaaaaagcggacggttcaccggtacgctgtttggatgacggggcggcgcaaaaaatgatggaagcgatcgacacggcaaagaaaaacggcgactcgatcggcggcattgtcgaagtgatcgcaaccgggatgccggccggtgtcggcagttatgttcattacgaccggaagctggatgcaaagctggcacgcgccatcatcagcatcaatgcgtttaaaggggtggaattcgggcttggctttgaaatggcacaccggcccgggagcgaagtccatgatgaaatcgcctggtcggaagaaacgggctatacgcgcaaaacaaaccggctcggcggctttgaaggcggtatgacaaccggcatgccgattgtcgtaagaggcgtcatgaagccgatcccgacattgtataagccgcttcaaagcgttgatatcgaaacgaaggaaccttttgcagcgagcatcgaacgttccgacagctgtgcggtgccggcagcgagcgtcgtctgtgaggccgttgtcgcctgggagctggcggaagcgatcactgcccagttttacagcgacaggatggatgtgctgaaaaaaacggttgcggagcaaagagaatacggaaggttgttttaaatggaaacgatcatcattgatacagaaacaaaacagtacccggtatacatagcaagcggcgcgctccaggagctaggtccgctcgtccgcaaatatacgcgctgcatggtcataacagatcaaaatgtccggccgcttcacttggacaaactgctttcacagcttccggaaagcgcggaacagtgtgtactgaccgtgccagctggggaagatgccaaaacgtttgaagtctaccaagaagctttgacgtttgccgtggaacatcatttagaccggaaatcatgcattcttgcctttggcgggggcgcggtcggcgatcttgccggttttgtggcggcaacctatatgcgcggcattgcgtttattcaaatcccgacaaccattttggcccatgacagcgcggtcggcggcaaagtagcgatcaatcacccgcttggaaaaaacctcgtcggcgctttttaccagccggaatttgtattgtatgacacagatttcctgcgcacgctccccaaaaagcagctgttaagcggatttgccgaacttgtaaagcatgcgcttctttcggataaggagttccttaaagaattgcaaacaaagattccggacggcgggcatcttttatccccgcatcttccggacttgttgaaaaaagggatcaaagtaaaggcagatattgtccgcaaagatgaaaaagaaacgggtgtgcgtgcctttttgaatttcgggcatacgcttgggcatgcccttgaggcgcacggcgggttcgggaaaatcacccatggcgaagcggtcatgaccggtatcgtctacgcgcttttgatcagcagggaacagaccggccttcaatttgatttgccgcaatttctcagctggatcgaaacgctcggctatgattggaaaattccggctggcgcagcatttgacgaaatctatgcttatatgaaacgcgataaaaaaacaattgccggcaatattcacttcgtcctgcttgagtctgtcggcaaaccggtgctggctgaagtggacaaagaccggctgagccgtctgtttctgctgcagcaaaagggggatttgcatacatgatacgcggaatacgcggagcgactacggtcgagcgcgatcacgaaagcgaagtccttgctgctacttctgagctgatgaatgccttgatcgaaaaaaacgggatcaagccggaccgcgttgcttcccttttgttctcggcaacagccgatatccgttcggcttttccttcgaaagtcatgcgccaattcagcggctggaagtatgtcccgattatgaatatgcaagaaattccggttgaaggaagccttgtccgctgcatccgtatcctgatccatgtcgacacggacattgggcaggaggacataaaacatgtgtatttgcgccgtgcagccgtgcttcgtccggatttaacaaaataagagaatgctaacgtgtcacgaaccgaaaggagagaatgcgatcaccccctggcttgcgctcttgcatggaagcaggggactctcgctaaagatgatgaaatggagaacaaaaattacggatttgcatgcatatgtgcccggaaagaccattgatgaagtgaaaaaacaatacaggctcgattcaatcgtgaaactggcatccaatgaaaatccgttcggctattccccgaaagtggatgaggctttgaaaaactttcagcctgcttttacccgttatccggacgggcacgccttacaactgagacagaaaatggccgcacatctcggcgttgatccaaccgaactgatttttacaaacgggacggacgaactgatccaaatcgtttccaggtcactcctcgaaccaggcaaaaatacggtgatggccgcaccgacattttcccaatacaaacataatgccatcatcgagggcgccgaagtccgtgaagtacccttaaaagacgggcggcatgacctggaggcgatgctcgggcaaattgatgaaaacacggcggttgtctggatttgcagcccgaacaatccgacggggacgtatacgaccgaacaggagttgaccgcttttcttgaccgcgtgccggaagacgtgctcgtttttatcgatgaagcgtacagcgaatacgtggtcgcaaaagattacgaacaggcgctgacattattccgccggtatcatcatttgattgtcagccggacattttcgaaaatttacggactggccggtttacgcgtcggctacgggattgccgatcgaacgatcatccaaaagctcgagccggtgcgcccgccatttaataccaatgtccttggccagctggctgcccaggcggcgttggaggaccaggcgtttatccagagctgccgcgacaaaaaccggcaggggctcgaacacttttatgcgttttgccgccgcaacagccttgcattttacccgtcgcaggcaaattttattttaatcgattttcaatgcgatagtgaggaagtttgccggtttttgcttggcaggggatatatcgtccgctccggggaagcgctcgggatgccggggacggtccgggtgaccatcgggtcggaagaacagaaccggggcgtactcggggcgatcggggcttttctggaaagccgcaaatgaacttgacaacggcgggccttttgacagcaaaaggccgcctttttacaaaaagaggtggcacctttgaaaggaaatgtgtttgtgatcgggctcgggttaatcgggggatccattgcactagcgattaaaaaggaacatccggaagccaaggtcacagggtatgatgccaaattggaagaaatgaaaatggcaaaagccctgatggtcgtggatgattacgtggaaacgatccaagacggcgtgcgtggcgcggatttaattatattggccacgccggtgcttgtaacggaaaaattgatcgggcagctcgggcaaatggaattgaaggaaaatgtgatcatcaccgatacgggcagcacgaaagaaagcatcatggcaaaggcgcagcggctcgccggcaacaacaccgtttttatcggcgggcatccgatggccggttcccataaaagcggcgttacggccgccagcctgtccctgtttgaaaatgccttttatttgcttacgcctttccatgaacaagatcagcggacggaagaattgaaacagtggctgaaaggaacaaaggcaaatttcatcaccgtttctccggaaatgcatgatgaaatggttgcggtcatcagccattttccgcatgttatcgcagcgtcacttgtccatcttgtgaaagatgcagatgcggaatatccccttttaaaaaggcttgctgctgggggtttccgtgatattacacggattgcctcctcaagcccgcaaatgtgggcggacatctcttgcggtaacagggaaaacctgatcaggcttttggatagatgggcgaaaaatcttcaggaagtgaaaaaggcgcttgcagacaacaagtatgagcttctccaccgcttttatgcggaagcgaaacaataccgcgactgccttccaatcagcggatcgggcgcaatcccgtctttttacgatttatttgtcgatattccggatgtcccgggggttgtttctcaaattaccaataaactggcggaaaaaggaatctctattacgaatatccgcatccttgaggcgcgggaagatatatacggcgtgctccggatcagttttcgctcggaaaacgaccgcgatctagccatgaatcttttaaaaaaagaaaccccgcatgaagtctatatccaatagaaggtggtggctgcaatggaaaaattggcacccgcgcaaacagggttaaaaggtacgattaaagttccgggggataaatcgatttcccaccggtcggttatgtttgccgctgtcgccaggggaaaaacgatggtagaaaattttctccccggcgccgactgtttgagcaccattcattgttttcagcaaatgagcgtgccgatcgaacgggatggcacccgggtggtgattgctggaaaaggatgggacggtttggcggagccggaaacggtgctcgataccggaaactccggtacgacgacccgcctgatgctcggtcttcttgccggccggcccttccattcggtcattgccggcgacgaatcgattgcaaagcgcccaatgcagcgcgtcacaaaaccgctttgcgaaatgggcgcgcacattgacggaagaatgggcggcaatttcacccctctttctataaggggcggggcgcttcagggaatcgaataccggctgcctgttgcaagcgcgcaggtaaaatccgcgcttcttttagccggtcttcaggcagacggcactacaatcgtgcatgagccgcagcccacccgcgaccatactgaacgaatgatccgggcatttggcggcgaggtcaggacggaagggagaacgatttccgtccggggcggcacggttttccatggcacggagatcgttgtgcccggcgatatctcatccgccgccttttttatggctgctgcttcgctcgtgcccgggagtgaaatcgtcttgccggatgtcgggctcaatccgacccgtgccgggatcattgacgttttaaagcaaatgggcgcggatatggaagtgatcgaaacacatgccccatctgacggcgagcaaacaggcacgttggtgatccgtccggctgctttacaaggcgttgaaatcggcggcgggctgattccgcgcctcattgatgaaattccaatcattgcccttcttgctacacaggcggaaggcaggacggtcataaaagatgccgcagaactgaaagtgaaagagacaaaccggattgacacggttgtccgggaattaaagaaactgggcgcccatattgaagcgacagcggatggcatgatcattgaaggcccttgccggctttcaggcgggacggtggaaagccacggggatcatagaatcgggatgatgcttgccgttgcatcacttgtggcaaaggatgctgtctgcctgaaaggggcggaagcaatcgccgtatcatacccgcagttttttgatgatctgaaatccgttctgtaacggctttagacgcctattgaaaacaggcaccagcaaaagaatgaaaatcagccggcgcctgttttcaggataacagagaacagcttgatcatgatgcccgtggaaaagcggggtgcggaaattcaaaatcccgtgccccgctttatttttgctgtgaaaaaaagggattttcatgcacggcggagaaatacttaaacagggaacccggaaaggcaaatgatttgccctggccttcaaaattcattatgatttagccaaaggccacccgcggtttttcctgcaggcaagtgggctccagggaaagggcgattgccattttaccaggggaccgggggagcgcttttagcggcaaccggggattttggctttgcaagattctggctttgcaaaaatcccgcggctaacgttgcaaaaggttcagcaaaaggaaacacatcaaagattaaaggaagattttcatgagcttaatggaacaattgttggatcatttggaagaaggccggctcgaggaggcgaaaaaaacatttgaagattttctcgcgctcggcacggacgaagagaaatatgcgcttgccgggcaacttgagggcctcggttttctgaatgaagcacagcaattatataaagatttgcttgcgtcttatccggatgacggcgagcttgtgatcttaatggcggaaacgcttattgatatggacaatgaagaagaagccatattatacctcgaccgcattccggagacggaccccgattacccgcgtgcactgcttttgcttgcggatttgtatcaaatgcagggcctgtatgaggtcagcgaaaacaaactgatggaagctgcatcgcttttgccggaagaacctgtcatccattttgcgcttgccgagttttacgcttcctgtgcccgatatgcggaagcttcccgtgaatatgagtggcttttgggcaaagggatcgatacatttgcggatacaaacatccacgggcgccttgcagaagtgctgagcgcagcgggcgcgtttgaagaggccttgcaccaatatgagcatgcgatggaaggccgctttgaggcgaacacattatttggatatgccttaaccgcgtaccaggcaggattttatgaaaaagcgatagagctgtttgaagaattgcgggaaacggatcccggctaccatccgctttacctgtatcttggccgtgcatatgagcacgaacaaatgccggaagaagcgcttgctgctgctgaaaagggcataaaagaagacgagtatgataaagaactttatcattttgctggaaaaatggctacaaaagcaggcgatgaggaaaaagcggaaaattattttaaaaaagcgctggaactggatcccggctatttggatgcggccctttcctacaacgagctgctgcttcaaaaggagcggtacgaagaagtccgtgaccgggccctcagcatggaaaaagaaggggataccgaccctcggctttactgggatctggccatatcgcttaagcatttggaagaatattctcaggcattaaagtattatggatatgcatataatgatttacaaaacgacacggtgtttctggaggattacggttatttcctgattgaagaagggagaaggaaagaggcttacggcattttccaaaagcttttgcgcgaagatccggcaaatgatgaatggattgcacttcttgaaaggcttgaagacggaaattaattgcggccatcgttgccggactttttcgtaggcggtttagacgggaaaaggtataatgaaggtgtaaaccaatgttttatcaaaaaagctgcccgctgtaaacacggccattcaatttgcagaggagggattacgatggctctcacccctgtttcaatcaacgagaaaaaggagtttatccgttggtttttaaatcattaccaattaaaaagacgggagtcagtctggattttgaattatttaatgagccacgaccagctgatggaaaaagtccatttcgtcgaggaagcgcatctttgcccgcgcggcattatcatgtcgacgcattgcgtggacaatgtgccgttccgcttttataaagataatattatgacaacggatgcggaaaagtctttccatgatatccggctgaaccgtgaggaagacatttatatccagctcaatttcaaaaaatcccatttatcgtaccagtatgcggctgtgcttgaagaaaacccgtatatgccgaaagatctccatataaacgagacagaccggcaaatggcggaaaaattattggaaaaaagcatgaaagactttaaacggaataaactgcgggaagaaatcgacaaagcgctcgatgagaaagattacggccgttttgtcgaattaagcggggagatgaaaaaactggatgattaatctttccggtttctgcccgcggggaaaatgaaaggggtatcatctgtgcgctggcgtgcaaaagacatggaattgtatcaacaggaacgttactttattgacacggcagtcctgccgcttgtcccggtttcattcggagaccatatccgacagctcgcttccggatatgaatggatccagatgatcgcaggctgcctcgagtcgcaatttaaaggccggattgttttgctgcccgctttcccttatttgcagcagacgatcccggacagtgcggggcctgccatcaagtcatgggaagccgaattgactgaaagcgggttccggcatattttttatttgaccagcgatcccggctggcaaaggcttcaggccgaactgaacggaaatgtggtctggctaccggctgtcccacttgaacatatggaacaaaaacagcaggatgccattgtagatgaacaggtaaaacagcttatctccattattgtccggtcatggggagaaaactgaaaaagttatattaaaatatcagtttatttcgagtagaaagatacttgacataaaatagacaatattcattgaccggcaaatatctttgttttatcataagagtgtatttgctacatcttgaaaatattaggaaaccaacagttctgtaagggggggaacaggttgagcaaaaaagatccggtgtcaaggaggcagtttttaaattacacgctgatgggcgtaggcggatttatggctgcgggtgcgctgatgccgatgctccgttttgccgtcgacccggtgctcgaggcggaagcagccggcgactttcatccaaccaaattgaaagtttctgatattaagagcgaaccggtgcgtgtcgattttaaatacgaacagacggacggctggtataagtcggatgtcacccagacggcctgggtgtataaagacagtaaaggcgatattgtggcgctttcaccggtttgcaaacatcttggctgtaccgtgaactggaatacgaacaaagcgcatccgaatcagtttttttgcccctgccacggcggacggtatgagaaaaacgggaaaaacataccgggaacaccaccttccgcgcctttggatgcataccctgtcaaaacaaagggcggctatctgtacctgggcaaaccgcagaaaaatccatatgtgaagtgagggggaagagatgcttagcaaattgtatgactgggtcgacgagcgccttgatattacgccgctttggcgggatattgctgaccatgaagtgccggagcatgtcaacccggcgcaccatttttccgcttttgtctattgttttggggggctcactttttttataacagccatccagattctgtcgggtatgtttttaacgatgtactatgttccggatattaaaaatgcctggcactctgtctattatttgcagcatgatgtggcatacggccagattgtgagaggaatgcaccactggggggcaagcctcgtcatcgtcatgatgtttttacatacgctgcgggtgtttttccagggcgcatacaagaagccgcgcgagctgaactggattgtcggcgtgctcatctttttcgtcatgctcgggctcggcctcaccggttatttgcttccgtgggatatgaaagcgctttttgcgacaaaagtcagcctgcagattgcggattcggtgccgtttatcgggccgtatattaaaacgcttttggccggccatccggatattgtcggtgcccagacgctgacgagattttttgccatccatgtctttttcctgccagcggtgctgatgctgcttttggcagcccattttttgatgatccgcaagcagggaatttccggaccgctgtaatgaataagtatccataacgggcaaaaggagggggaaggatgcatcgcggaaaaggaatgagatttgttggtgattccagaattaatgcggaccgcaaaccgaatattcctaaggattactcggagtatcccggtaaaacggaagctttttggccgaactttttgctgaaagagtggctcgtcggcgctgtttttctcgtcggctttttatgtctcactgccgcacacccgtcgccgcttgaacgaattgcggacccgacggatacgagttatattccgatgccggactggtattttctattcctgtatgaactattaaagtatacttattcttccggcccgtaccaggtgatcgggctcgcgatcccgggcgttgcttttcttgcactgctgttggcaccgtttattgaccgcggccctaagcggcggccgcttgacaggccccttgcaaccgggtttatgctgctcgcggtttgtgcaatattctacctgacatgggaagcggcggcccaccacgattggaaaaaagcgaaagagcaggggaaaatcgtgaaacaggttgccattgacaaaaacgcagaaggctataaaatatttgccaagcagacgtgtgtgacgtgccacggagaaaatctccagggcagtgcggcagccccttctttagtcggcacaggcttaagtgcggatgaaatcgcaaaaatcgccaaaaaaggcaaggggaaaatgccgcctaaccaatttaaaggctcggatcaggatttgaaaaaactggcggattatatcgccgggctaaaatcgaaataaaagcaaaaaaagccggcagaagccggcttttttcgtgctttctgttttgttaaaatgaatctatcttttttgaaatgggggaagacgatgaatgtaccggcattgtatgcggcgctggcagacaggcgtgtcctttggatgctttttttagccaatgctgcagggaccatttatggttacatttggtacgggtggcagcttcgcgatacgccgcctgcgttttggctgtttgtcccggacagcccgaccgcaagcctgttctttctgtttgtgctgcttgcctttttatggcggaaacactggccgtatgtggaggcacttgcaatggtgacgctttttaaatacgggatttgggcggttgcgatgaaccttctcgtattgatcgtaaacggctcattgccacggcagggatatatgctgatggcttcccatttggcaatggcgatagagggaatattgtatgcgccgttttaccaattcaaatggaagcatcttttggttgcggcggtatggactttgcacaatgatattattgactacgtttttatgcagtttccccggtacgaagatgtataccggtatatccgtgaaatcggctattttaccttttggctgagcatcctttctcttttgcttgcataccggtttgccgtgcacaaaaggcggctccgcctcgaactttaaatcgctttttccgtcgacagaaagcaggaatccccgaaatggacgccgggctgtttttatggtctactcttgtccctcccttcataagttagtaacagtatgaggggggacaaggatgaggagaaaagtagtgatccttctttgtgtgttcatgttaagttttgccggaaaaagttttgcaaaaggttcggatgatgctttggcacatttaaatgatctaagcgacgaggcattgcagctggcgaaaaacgggcaatatgcagaagcaaaaaatgtgctgaatgaattttcgaaaacattttccaggcaatcgtttaaaaataaacgtttaacgatggatgaattgagagttttgaccgtcactcatgatgaagcggtaaaggcgttgacgaaagtaagcgcagagcctgaggagaaagtggatgcctgcacgtcattccggctcgtggtggatgcgatccaatcgaagtatcagccgctctggacgcagatggaagggccggtgatgtcttcatttacagaggtgcaaaaagcagccgcaacagggaagcgtgaaacgtacaacgaaaaattaaacctgttcctcaaacaatatgcagtgatcgagccgagtttaagagtggatctgccggttgaaaaaatacagcggctcgattcgaaaatcgcttatattgaccgttatcgggacaaggtggcaggcagcgggtccggaaaaaaggaactggaggcgctccggacagatttgaagcagctgtttgaagccatgaaggaagatgaagccgacccctccctctggtggattatgatttccaccggcagcatcatcattcttactttatcgtatgtcggatggagaaaatacaaagggcaaaaagaagagcgtcacgagaccgatcatatggattgaccttttgaccttattcggatacaataaaggtaagattaccatggagggtatggagggtggcaaatgtcgtttttgatttactatctcattttggcaatcattccgatctgggcccagctgaaggtaaaaaacacatacagcaagtatgaaaaggtcgcaaatgcatccggcatgacaggcgccgaggtggcaaggatgatcttggacgaaaatggcttataccatgtgaaagtgctggaacacagcggctttctaagcgaccattacaatccgattaacaaaacggtcaatttgtcgactgccaactaccacgggcgttcgattgcgggggctgctgttgcggcgcacgaatgcggacacgccattcaggataaagtcaattacgggccgctccgtttccgtcaccgcctcgtgcctgtggcgaatatcggcagcaatgcctcttggatttttattttgatcgggatgttcacgcatgcgacaggcatgttcctgctcgggatcattctcatggggcttgccgtgttgtttcagcttgtgacattgccggttgaattcaatgcatcgtcccgtgcgcttgcacaagtcacatcgctcggcattgtccgcggcggggaagaaagggaagcgcgcaaagtgttatcggctgccgcgctcacatatgtggctgccgcggctgttgcggtcattgaactgctgcgtttaatcctcatctttaccaacttaaacggcaataacaacaataattaacagtacgaaaagctttccggggtgaatcggcaacccggaaagctttttttgtcttgctgcatgttctagtttgcattataataaagaagtttggttgtttccaacccgtggttcgaaaccatcccacgtaaaaaaactaaggagagatgcatatgaaactgaaaacactcgtcgtcaacgggattgtcgccgcgctgtatattgcggtgacattttttattcagccgcttgcgtttatgaacatccagttccgtgtttctgaaatttttaaccatctcgttgtgtttaacaagaagtatatgattggcattgtattaggcgtttttctctcaaacttgtttttctcgccgatcaagtatgatatgttcatcggcacgggtcagtccgtccttgcgcttgcgattaccattttatccgcacggtttataaagggcgtctgggggcagatgatccttaattccattgcttttacggcctccatgtttattatcgcatgggaaatgcaatggtttaacggcgtgcctttctttttcggctggctgacggcagggatcggtgaacttgctgtgatgctgattggtatgccggtcatctacctgatcaacaaacgcctgcattttgaaaaacagatttaaaaaagagctgccgcggcagctcttttttaatcttcaatcggctgtttgttctcatcgagtgtaaagccttccccgagcacatcatggacctccatcatcgacacaaaggcatgggggtcaacggaatggataatgccttttaaacgggacacctcatgttttccgacgacacagtacagtacatcccggtcctgtttcgtgaacataccgtgcccgcgaaaaaccgtaacgccgcggtccatctgcttcataattttctcggcaatttcatcatgcttgtccgaaatgataaaagcgcctcttgccgtataggccccctcctgcagaaaatcgacaacacgcgagccgacaaaaacggcaacgagcgtgtacatcgcttcacggtaatgcagataggtgataagcgacagcgtaatcacgcatgcgtcgaacatgaacatggtcctgcccatcgccacgcctttatatttaaacacgagcctggcaatgatatcgacgcctccagatgtccccccgtagcggaagataatgccgagaccgacgccgataaataccccggcaaacagcgccgcaagaaacatatcatcgcgaagcggaatatggaaatgtttcttctcaaaaatccataaaaaaagagaggagccgaccgtcccgaccagtgtatagtaaaacgatttttttccaagtagcttccatcccacaaaaaatacgggaatattcaaaatcagattggagtaagaggggttgatatgaaataaatagtaaagcagcagcgtaattccggtaaaaccgccttccgccagatggttctgaatattaaaatggacaatgccaaaggcaaagatgcaagagccgagcaggataaaaaagatgtttttcattttcagcataatccgtatcctccttccccggtatatatccggcgttcccattatagcgaaagcggtacaaaagggcaatcaggcagagagaaaagcaaatatatgatttgtaaaatctgccgtttttggctaacatggaagaggattacaggattgggggatgaaaatggcagaaaacaaatcgatccggcaaatgcaaaaagaagtcgatgattatatcagccagtttgaagaagggtacttcagtccgcttgcgcttacagcaaggctgacggaagaacttggggagctggcgcgcgaaatcaatcattattacggggaaaaaccgaaaaaaccggatgagaagccgaaaaccgtagcagaagagctcggcgatttgctgtttgtcgtcatttgcatggcaaatgctttacatattgatttacaggaagcccatacaatggttttgcagaaatttaacacgcgtgataaagacagatggacgcgaaaagagcaggaggagtaatgaaacatggatgatattcggattattgttgccggggcccgcgggaaaatggggagcgaggcggtccggctgatcgagcggacggaacattttaaactcgttggcgtagtggacaggacttttgatggcaaactgttcaatgatgtatccgattataacggcgaaccggtccgggtgtataccgacccggaagcatgccttgaaaattgcccggcggatgtatggattgatttgacggtgccgaaagcagggttcctccatgcgaaaacggcccttgcacatggtgtccgcccggttgtcgggacgaccgggtttaccgatgcggaactggaagaactaaaggccgtttccgcacaaaaaggaatcggctgtatcattgcaccaaattttgcaatcggggcagtgctgatgatgaaatttgcgcaaatggcggcgaaatatttcccggatgtggaaatcatcgagctacaccatgaccggaaaaaagatgccccgtccggcacgagcgtaaaaacggcgcaaatgatctcggaagcaagaagaaaaaaaacacaggggcatccggatgaaaaagaaacattacaaggtgcaagaggcgcggattttgaaggcatgcatatccacagcgtccgcctgcccggccttgtcgcccaccaggaagtgctgttcggcggggacggccagctgcttacgatccgccatgactcgatggatcgcgcctctttcatgtcaggggtgaaagtagccgttgaaacggtgatgaacctcaatacatttgtttatgggctcgaaaatattttggattaaccggaaggaggaaaggaaatggccggcaaggtggatattctcgctttcggggcccatgccgacgatgtcgaaatcggcatggcggcatctattgccaaatgggcatcaatggggaaaaaaattgcgatatgcgatttgacagaagcggagctgtcttcgaacgggacggttgaaaaccgcaaaaaagaggcgcaaaaatcggcagcctgcctcggggttagagaaagagtaacgctgaaattgccagaccgcggcctttttatgcaagcggacgctatccgtgccgttaccggtgtcatccggaagtttcagccggatgtcgtgtttgcgccttttcatgaagaccgccatcccgatcacggtaactgcggcaggcttacagaggaagcctttttttcggccggcatcgggaaataccgttctgaaccggatcttccttcccataaaccgaaacatctttatttttatatggtaaacggttttcatccgcccgattttgtcgtcgatgtcaccaactttatggacaaaaaacttgagagcctccatgcctatgaaagccagttttcgatacgggaaagaagtgtccatacaccgcttacggatggctatattgaagcggtcaccgcgcgtgagaggatgttcgggaaagagctcggggtgaaatatgcagaagggtttttaagcaaaaaaccggttcttgtgaatttggatgtgctcgacttatgaaaaagttaaaaatcgggattacgtgctatccgaccgtaggcggatccggcgtcattgcaacggaactcggccagctgcttgccgaaaacggccacgagatccattttattacctcgagtgtcccgtttcggctcaataaaatgtacccgaatatttatacccatcaggtggaagtgaaccagtacgccgtctttcaatatccgccttatgatattgcgcttgcctctaagatcgcagaagtggcggaaagggaaaagctggatgtgctccatgtccattatgcaattccacacgccatctgcgccattctcggcaaaatgatggccggcacccggatgaaaatcgtgaccaccctgcatggcacggacatcactgtgctcgggtatgacccgtcgcttgtttccgccatccggttcgggattgaacagtcggatgcagtaacggccgtttctgaagcgctcgtccggcaaacgtacgatttgatccggccgcagaaaaacatttcgacggtttataattttgtcgatgaacgcgtataccggaaaagggaggcaggccatttaaaacaggattacggcatttcggaaaaggaaaaagtgctgattcacgtttccaatttccgggcggtaaagcgcgtgcccgatgtcgtcaaggcttttgcgaaagtgcgggcacaaatgccggcgaaactgctccttgtcggcgacgggccggaaatgactgtcgtctcccggctcgttgcccaattcggtatagaaaaagatgtcttgtttttaggaaagcaggaccggctcgaggagttgtacgcaatcagcgacctgatgctgcttttatcggaaaaggaaagtttcggccttgttgcgcttgaagcgatggcgtgcggtgtcccgtgcattggcacccgggtcggcggcattccggaagtcatcacagacggggtgaacggctatttgtgcgcgttgggtgatgtgagcgacgttgcccgaaaagccgtccggctgcttgaggatccaggcctttatgctgcattttcgaaagcgtgcgaaaagacggtaaaagagaaattttattcccgcaacattttgaaacaatacgaacaaatatatgaacaaacggtaaatgaggttgatggacatgctcccgccatttcagacggcgcttcccattatccggacgcttgaagacgcagggttcaaagctttttttgtcgggggctcgatccgcgatagcctgctcgggcggccggtgcacgatgtcgatattgccacctcggcgaaaccggaagaggtaaaggcgctttttaaacatactgttgacatcggcattgaacatggaacagtgcttgtattatataaaggaaaccagtacgagatcacgacgttccggaccgagtcggcctataaagattaccggcgtccggaatcggttgaatatgtggactcattgcttgaagatttaaaacggcgcgacttcacgatgaatgcgatggcgatggataaaaacgggaaactgattgatccgtttagaggcagtgaagccatccggatgaagcggattgaaacggtcggatcccctgaagaaagattccgggaagacgcgctccggatgatgcgggccgcccggtttacaagtcagctcggttttggtattgaacccgggacgaagcaggccatcaagcgccatgcaccgcttatccgacatattgctgttgagcggataacccaggaattcatcaaattgctggaaggagagcatccgtatgaagcacttcaactgcttcaggaaaccgggctgctggggtttctccccggtctttgcgacagggaagcacagcttttttccgtcctgcacccggtgttaaacgaattgtcagaacagcagctttgggtgtaccttgttgccgccgcgaacccggaagatgccaacgcttttttgcgaaaatggaaactgccgaatgaaaaacggaaagccatcgtgcgtacgctcagccttttcaggatgcgcgccgggcgaaagtgggatccgcttatgctctacgatgctggcgaacaaacggcattggatgctgaagcggttttctgtgcttttcgccgcgaaaacccggcgccccgcatttccgctctccggcaggctttccagaaattgccggtgaaaaaccgcagcgagctggcaatcgacgggaaaaagctgatggcgcttttttcgaaaaaaggcggcccgtggctgaaagaaatgctccgtgagattgaaaaagcgctgataaacggcgaaatcgaaaaccaatatgaggcaatccggaggtgggttttgtgcaaatatccacaagagaaaaaataatagaattgctaacggaagctggggacggctttgtatcgggagaaacgctggcgaaaaagctgaactgctcgcgggcggcagtttggaagcatatggaagagctgcgcaaagaaggctttgaattggaagcggttcggaaaaaaggctaccggattaaaggaacgggcgacaaagtgacgaaaaatgaaatccggtacgggctcgggacaaaacggcttgcaagaaacattcattaccgggaaacgatcgattctacccagcggcttgcgcaccagctcgtacaggaaggctgtcctgatggcacgcttgtgattgcagagcagcagacgggaggaaggggcaggctcaggcggtcctggtattcccctaaatataccggtatctggatgagtattgtcctgcggccggatcttccgccgcaaatggcgcccccgtttacgctcattgccgccgttgcggtcgcacaggcaatcgaagaaacagcggggattgtgccggagatcaaatggccgaatgacctgttaatcggcggaaaaaaatgcgcagggatcctgacagagcttgaagcggacacggatcggatccaggcggtgatcacagggatcgggatcaatgtaaacgaaaccgatttcccggaccccttaaaatcgatcgcaacatccctttcccttgcttctggtaaaaaagtaaaacgcgcgctgctcattcagcgcatccttgagaaattggaaaaatacgaggaaatttatctccaaaacggttttgcgccgcttaaaattttatgggaaagctatgccaatgtggcagggaaaaaaatcacggcgcatacgttaaaaggggatatttcagggagtgcggtcggcatcacggatgacggcgtgctccagcttgaaggggaagacggacagatgcatgccatttactccgcagatattgaaatcgaacgttaaaaaattgacaaaatttttggccggatatagcgcaatctggccattcctgctataatcaacttgggtagtatctatttcggaactacaccaattcagctttttatacaaaatagattctgccttgatccttaaacggacggggacagagggccaaaatgaacaattgaaacaacagggagcccgtctgtccagtgacgggctcctttttccaattgtttgtttcctctgcaccggtcaatccatgacaggtgaggagtgttggaaaatgaaacaaacgacggattttgtgaagatgaaggcgcaagaagaaaaaattgcaatggtgaccgcttatgattatccttctgcaaagcttgcggaagaagcgggcgttgacatgattcttgtcggcgattcactcggcatggtcgtgctcggctatgattcgaccattccggtgaccgtggcggacatggtccaccatacgaaagcggtcaaacgcggggcgaaaaacacttttatcgtcaccgatatgccgtttatgtcgtaccatttgagccgcgaagaaacattaaaaaacggcgcccgcatcattcaggacggcggtgcccatgccgtaaaactggagggcgggaaagaagtcgcggctcaaattgaagcgcttacggaatcaggcatcccggtgatggctcatatcgggctgacgccgcaaaaggtcgggattttcggcggctataaagtccaagggaaaacagcggaagccgccaaaaagctgctggaagatgcgaaagcgtgcgaggaggccggcgcttttgctgtcgtcctggaatgcgtcccgcggcagctttcggaagaagtgacagccgcactttccattccaaccatcggaatcggggccggccttgatgtagacgggcaggtccttgtattccatgacctggtaaaatacggaagcgaaaaagtggcaaaatttgtgaagcaatttgccgatgcggatgccgtgatgcgcgcggggctccgccaatacgtacaggaagtaaaaaaccggacgttccccgaagaaaagcatacgtacacgatgaaagaagaagaactggcaacactgtacggggggcatgcaaaatgaaaaccgcacaggcgatgagcgttacagaaacgaagcaggaaatccgggcgctagtatcccggtataaaaaggaaggcaagtcgatcgggtttgtcccgacgatgggctacttgcatgaaggccatctcgccctggcaaagcaggcaagaaaagaaaacgatattgtcatcatgagtatttttgtaaacccgctccaattcggtccgaatgaagatttcgaccggtacccgcgcgatgccgaaggggaccggcataaagcggaagcagccggcgttgatgtattgtttatcccttctgttaaagaaatgtatccgcgcgctttatcggttcaaatgacagtgacaaaagggacggatgtcctttgcggaagaaagcggccgggccattttgacggcgtggcgacggttctttcgaaattgtttcacctcgttcagccggaccgcgcttatttcggattgaaagatgcccagcaggtggccgttgtcgaaaatttggttcgcgatttggattttcccattgacattgtcccgtgcccgatcgtgcgcgaaccggacggccttgcaaaaagttcgagaaacgtctatttatcggaggcggagcggaaagaagcacccgaaatatacaaaagtttgcaattggcaaacaaagcggttgaacagggagagagaaacccggaaaaagtgatttcccttgtgaaagcgcatctttccgcgcatctgtccgggaaaatcgattacgtagaattgtattcatatcctgacctcgaaccggtccatgccatacatgggcgctgtatcctcgcagtcgccgtccaatttgaaaaagcacggctcatcgacaatatcatttttgcagaataaacaacatgagaataggagagattgctttgctgcggactgtgatgaacggaaaaatccaccgggcaaccgtgacggaagcgaatttaaactatgtcggaagcatcacgattgatgcggatttgctggatgctgcgggaatggcgcccaatgagaaagtgcaaatagtgaacaattacaacggggcgcgatttgaaacgtacattatcccgggtgaaaggggatccggtgtcatctgcctgaacggcgcggccgcccggcttgcacaacccggcgatattgtgattatcatttcgtacgcccttttgacggaagaagaaatgaaaaaccaccatccgaaaattgtcctgcttgatgcaaaaaaccgaattgaaaaaatgttatcggaagaaccggcttccacgattttgtaaggtaaaaccgcacctgctttttccggcagggcggttttttaatttctgcatctgcttgtggcgaatgatcgattttatgttaaaatagtacaatatggaagaaacggggcaattatttttagtcaggtgatgttatgcagcgctatgtagtcgtagatcttgaaacaacaggaaattcagcaaaaaaaggcgatcgcatcatccagttttccgctgttgtggttgaaggccgggagataaaaacgcaatttacaagcttcgttaatcccgaaaagccggtaccgccgtttatttcggaattgaccgggatcgataacggcatgcttgaagaagcgccggtattttcggagatcgccccgcgcattatggaaattttggaagacagcatatttgtcgcccacaatgtgctgtttgacctgccgtttttgcagcaggaattaaaggctgcggggtttccgccgtttcgcgggccaagccttgacaccgttgaattttcgagaattgcatttccaactttgaacagttataaactgggggatctggccgattctttgtctctttatcatgaacggccgcaccgggcggacagtgatgcttttgtgacggcaaagctgcttcttgcctgcatggaaaagtgtgcgtcccttcctgtcgtcacacttgaacaactcgtgccgctttcttattccttgaaaaacgaccttgccggcatttttgaggatatactggaagagaaacggcggcatatcgagcatttgccgccggatatggaagtataccgtggtattgcattaaagcggaaaatcctcccgccggataacggaccgcgtgagattggccgttacccgcaggatgcagttgaaaaagaatcctggttttcggcttcaggtaccgggatggaagcgcgccccgcccaatttgaaatgatggaccatgtccgggaagctttttctgctgaggagcatgtcgcattagaagcaggcacgggcatcggcaaatcccttgcctatcttgtgccggccgctttccaagcgatttcggaacagaaaccggtgttaatcagcacgtatactgttgcgcttgagcaccagcttttaaataaggaaatcaaaaggcttgaacagatgctgaaaaccccggtcaggaccgtgttgctaaaggggaggagccattacctgcatttgtttaagtttgaacagtcgttaaaagaaccggaccggcagtacgacgccgtatttgccaaaatgcaaatcctggtctggcttaccgaaacagaaagcggcgatcttgacgagcttcatttatctggcggcggaaaacatttttggcagcggattaaacaggacggctggcatacggataaaaaagatccgtggaaatcgcgggatttttatctttacgccaaagcctgcgcagcctctgctgacatcgccgtcacgaaccatgcgatgctgtgcgcggaacttgaaagggaccagtcggtgtttgacggatttcaatacgtcatcattgatgaagcccaccgccttgaacaagcggcccgggaaacgatcgggaaacgcgcaagttacaaccaaatgaaatatatgatggcaaggcttggtctgtatgagcaaaaacaactgttttacaaattggaaaaaatgatggaaaaatatgggctaaaagcccgactgcacgcgtttgaatgcgatgcaatcctgcagggccttgatgccgagctcgatgatttattcggcatgctcgctcaaaaagtgttgcgcgcgaaccgggaaacaaatggttaccagaaaatcaaattaagaattaaaaaagaaaattggaaacaaaaagcatggcaggcagttctgctctgtacggaacggatcagggcgtccatgaaagagatttcacagactttggaagaaagactttcgcagttgctttccgaaaaaaagatgaaagaacaggcactcgcatttatcgaagaaatgtacagctttttggaagattggcgccttttgcgcgacaacctggccattttcgccggccaaaacggcggggatgaaaatgtcgtctgggtggaaggggatttgcgtgccctcccgaacagccttgtcatctattgccagccggtgcatgccggagaaacattgcaaaaagcttttttttcgcgaaaaaagagcgttgtgcttacttccgcgacattgaccgttggcggaagcttccgctattttctggacgagacggggctagcgcacaccacaaaaacggtccgcattccgtcgcctttccggttcgacaggcaggtgcagtttattatcccgaacgaccttcccgatatcggatccgtcagtatagaagactttgcggaaaaaatggcaggttatctgcttgccgttgcggaggccacaaaaggcaggatgatgattttatttacatcctttgatttgctgaaaaacgtgtaccacctgatgaaagaaagcggaatgcttgaagattatatgtttatcgcccagggaatatcaagcggcagccggtcgaggttaacgaaaagctttcaaaaatttgacaaagccattcttttcggtttaagcagcttttgggaaggggtcgacatccctggcgatgacctttcctgccttgtgatggcccgccttccgtttttgcccccggatgaaccggttactgaagcaaagtccgattatttcagggcaaaggggaaaaacccgttttccgcctatgccttgcctgaagccgtgctcaggttcaaacaagggtttggcaggcttatccggacgcgtcatgaccgcggcatttttcttgtcctggaccggaggattgaaacggccacatacgggccggcgttcacaaagtctctgccgccggtccgcatcaggcacctggatctgaacgagacgcttgaggtcattgaaagctggctgtaaaaaaagtgctgcgacaatgcagcacaaaacagggtagaccggaaaaatgatcaaatgcatcattttttcattcatttttgctgtataatgatgaaggaaatgattctaagcttaggatggcctgcatgggaactgatatgaatgacaatttctgcttaaaaggatttacgccatggaaaatgagggttcggaatgaaaaaagcactgatctcgatttgcattttggtcatcgtgatagccggatttgcggcagagacttattggaaagcacggaaaccgtatcatgaagcctacaacaaagcggtcgctgttgccaaaagcgaagccggcatccgggctgccgatgcattttatctttacaatggcaaaagcacctattatgttgtcgtggggaaaggaaaaggcgggaagaaaaaagcggtttggatccctgaaaagaaaccgaaacgtgtgaccgtcctagacttgaataccggcatctcaaaacaggatgcagtgaaacaagtggtgcagaaaaggcagccggataaaattttatctgtgcggctcggcatggaaagccaggttcccatttgggaagttgcttatataaaaggaaacagcctcggctatgatgaggttccttttttaaaaaaatccaattgatccgtttggagaggtgaatcgtatgaaactggcatcaagggtaagtgcattaacgccgtcatccacgttggcgattacggcaaaggcaaaagcaatgaaggcgcaaggcatcgatgtgatcggccttggcgcaggtgaacccgattttaatacaccgagggagattatcgaagccgcgtaccagtcgatgctggacggccagacgaagtataccccggccggcggaatggcatcgctgaaagaggccgtcattgaaaaattccaaaaagaccaggggcttggctttaaagcaaatgaaatcatcattaccaacggggcaaaacacgccttgtatacattgtttcaggtgctgctcgaccagggcgatgaagtgatcatcccgtctccttactgggtaagctatcccgagcaggtaaagcttgcagaaggcgtcccggtctttgtagaaggcaaagaagaaaaccagtataaaataacgccggagcagctggaaaaagccatatcgccgcggacaaaagcgtttgtactcaactctcccggcaatccgaccggcatgatgtatacaagggaagaacttgaaaaactcggtgaagtctgcctgaaacacgatattttgatcgtgtcggacgaaatttacgaaaaattggtgtacggcggcagccggcatgtctcgatcgccaccatttcaccggaactgaaagcacagacggtgatcattaacggcgtctcaaaatcccattccatgaccggctggcggatcggctatgcggccggaaacggggatatcatcaaagcgatgacaaatcttgccagccattcgacttccaatccggcaacgccttcccagttcgcggcactcgccgcatatagcggggatgaacgcaccgtggaagagatgcgccaggctttcgaggcacggctcaatgctgtttttaaccagctgattgaaattgacgggattacctgcatcaaaccgcaaggcgctttttatttattcccgaatgtgaaagaagccgcaaagctgactgggtttcaaacggttgacgcatttgtggaggctttgctcgaggaagcgcgcgttgccgtcgtcccgggttccggtttcggcgcggaaaacaatatccggctttcttatgccacttctttggaaaatctcgaagaagcgctcaagcggatcaaacagttcgtggaaacacggaaaaaagcgtgaaactttggcttgtttcctttttccgcctttgtttagtataatggatttcggtacatatgggagacaagccggaaattgttttggagggaaataccgtgaaaatcaccatttcagaagtacaccagcatatcggggaggaagtgacgatcggggtctggctgaacaacaaacgttcaagcggcaaaattgcttttctcgagctgcgtgacgggacaggctttatccagggggttgtcgtaaaaaacgaagccggggaagaggtctttcaaacggcgaaatcgatgagccaggaaacttctttttacgttaccgggacagtccgggaagatgcccgctccccgttcggctacgagctccaggtgaccggcatagagatcattcatgaagccgtagattacccgatcacaccaaaagcgcacgggaccgaatttttaatggaccacaggcatctatggctccgttcccgccgccagcacgccgtcatgaaaatccggaacgagatcatccgggcgacgtatgagtttttcaatacgcacgggtttacgaaaatcgacccgccgattttaaccggcagtgcgccggaaggaacgaccgagctgttccatacgaagtactttgacgaagaggcctatctatcacaaagtgggcagctttacatggaagcggcagcaatggcattcgggaaagtattttctttcggcccgacgttccgcgccgaaaaatcgaaaacgcgccgccatttgatcgagttttggatgatcgagccggaaatggctttttatgaacatgaagacagcctgaaagtacaggaacagtatgtctcttatatcgtccggtccgttttggaaaactgcaaactcgacctgcaccggcttggccgcgatacttcaaagcttgaacaagtgtcggcgccgtttccgcggattacgtatgatgatgcaattgaattgctccatgaaaaaggatttgaggatatcaagtggggcgaagattttggtgcgccgcatgaaaccgcgattgccgaaagtttcgacaagccggtgttcattacgcattatccggctgcaatcaaaccgttttacatgcagccggatgctaagcgcccggaagtcgtgctgtgcgccgatttgattgcgccggaagggtacggggaaatcatcggcggcagcgagcggatcaatgactatgatttgttgctgaaacggatcaaggatttcaatctgtcggaagaagcttacaaatggtatcttgatttacgaaaatacggttctgttccgcattccggcttcgggctgggccttgagcggacggttgcctggatttcgggcgttgagcatgtgcgcgaaacgattccgttcccgaggcttttaaaccggatctatccgtaattaatagaaagccccctggcagtataaaccctttgcaaaaaaaccggttcatgctacactagtgacgatctaaaaaaaggcggaatggacaatgaaaaacggaaaaagcaatgtggtgccgttcccccgtctgaaagaacgcctcttggagcggggactcgaatccatcagccaaaaagaatataaagaagctgccgcgctgcttcgccaggcacgccggcttgaccatgacgatggggaaatcgggaccgcctacatgattgcgctctatgaagccggcgattatgaaggggcgaaagaacaaggcagacaaatgcttcgtgaaggaaacggtgactacttcgaaatcctcgatctgtttctcatgattcttgtccagctcggtgaacatgaagaaatcagcagtaccttgcgcgctctgctggaagaaaaagaagccccaccggacaagctggatcattatgaaaaactgctcgctttcagtgaaaagcggatgcaaatgccaaaaccagaacgggagcccgagcatacgggccgtaagctttttgaaaccggggaccaggaagaacaaatcttgcgggtttcgcatcttgtgcatgaaaatatccggccgtatctcgatgaaatccgggcatatatccgggatccggacaaacatccgtttatccagacccttttgctgaacgttttaaaagaacaggggatcacggatgaattcgaggtgcaaaaactcggcaaggctggcgccgtaaatcccgcgcatcttttgccgatttttgaaacgcagctgtataatcttttgattacgcggctttcaagggatgtcgaacaaaaaaatccgacactttttgctcagattaaaacggttttggaccggcattttttcctgctgtacccgtttgaaccggagccggaagatcccgcgctgtggacggctgcctactacagcatgggcctgaagcttttcgggcaggaagcgtattttgataaaatcgcgatgtactattcggtggagccggataccttgcttgaggccgtccgctatctcgaaagccttgaggaaatttctttgccgaatctgtaggctcatcattgaaagacaaaaaagctatgttataattaaatggttgtaaactgtcttttttcaatccgtatttgaaaaaagcaatagacaagggaatcaggaaacagacccggtctatttcctattattacattattatttatagattgttggagggaaaggtatgtcagcaaaatgggaaaaaactgaaggaaaccaggggatcctgacagttgaagtagatgctgaaacggttgataaaagtctggataaagccttcaaaaaagtagtgaaacaaatcaatgtcccgggtttccggaagggcaaaatcccgcgtcctttatttgaaaaacgtttcggtgtagaatctctttaccaggatgcactggatatgatcgtgcctggcgaatacgaaaaagcgatcgaagaaaccggtattgaaccggttgatacgccgaatatcgatgtcgaacaaatggaaaaaggtaaaccgctaatctttaaagcgactgttaccgtgaaaccggaagtgaaacttggcgaatacaaaggccttgaagtcgaaaaaccggatacagacgtaacggacgaagacgtggaagaagaattgaagaaattgcaggaacgccttgccgaactcgtgatcaaagaagacggcgaagcggaaatgggcgacacggttgtcatcgacttcgaaggattcgttgacggcgaagcgtttgaaggcggatctgcggaaaactattcgcttgaacttggttcgggcaactttatcccaggttttgaagaacaattagcaggcgtaaaaaccggcgatgaaaaagaaattgaagttactttcccggaagaataccacgctagtgaacttgcaggcaaaaaagctactttcaaggtgaaagtccatgaaatcaaagcgaaacacctgcctgaactggacgatgaattcgcgcaggatgcggatgacgaagtggaaacgctggatgcattaaaagaaaaaatccaaaaagatttaaaagaatcgaaagaacatgcagcaaaacacgcggttgaagatgcagtggtcgaaaaagctgcggaaaatgcagaaatggacattccagaagcgatgatcaatacggaattaaaccgcatgctgcaagaattcgaacaaaacttgagtgcccaggggctgaacctcgaactttactatcagttctccggccagaatgaagaagcgctccgcaatcagatgaaagaagatgcggaaaaacgcgtccgctttaatctgacgcttgaagcgattgccaatgcggaaaaccttgaagtatccgatgaagaagtggatgaagaactgaagcgcatgtccgaaatgtacggcatgtccgttgacgatatcaggcgggtgctcggttctacggacggcattaaagccgatctgaaagcgcgcaaagcgatcgattttcttgtgcaaaacagcaaaactgttgcataatataaatagaaatacaaggcacggcactggctcgtgtcttgttttctaacctgcgggctgtgccaaaaaatacatagaagcccatactgtaagataagcgcaccagaaacttagccgatgcaatttttcaggatggagaagcatattcgtctggtttttgggaaaatctggagtagacaggaattttacatatgcatggagaatggtataagcagtttatttcctgccggcatcgttttgtgatacaatccatatacaaatcacagcaaaaggggtttgtataatggtaagcgggagtcatgaagggtccctgttatttcgggaactgccaatggaatggaagaagtacaatataaggggtgaatggaatgttcaaattcagcgatgaaaaacagcagttaaaatgttctttctgcggaaaatcgcaggaccaggtgcgaaaattggtcgctggtccgggtgtgtatatatgtgatgaatgtattgaattgtgcacggaaattgttgaagaagaatttggcacagaagaagaagtagaattcaaagacattccgaagccgcatgaaatccgtgaaattcttgcggaatacgtgatcggccaggaacaggcgaaaaaatcgcttgcggttgccgtatataaccattataaacggattaattccaacagcaaaatcgatgaagtcgaactggcaaaaagcaatatttgcttaatcgggccgacagggagcgggaaaacgctgcttgcgcaaacgctggcacgtattttaaatgtgccgtttgcgattgccgatgccacatcgttgacggaagccggttatgtcggggaagacgtcgaaaatattttgttaaagctgattcaagcagctgattatgatgtggaaaaagcggaaaaaggcatcatctacattgatgagattgataaaattgcccgtaaatcggaaaacccttcgattacacgcgatgtttccggcgaaggcgtgcagcaggcgctcctgaaaattctggaaggcacggttgcgagcgttccgcctcaaggagggcgcaaacatccgcaccaggaatttatccagattgacacaaccaatattctgtttatttgcggcggtgcgtttgacggcatcgaccagatcattaaacgccgcctcggcaaaaaagtgatcggtttcggcaccgatttaaaaaatgacgaactcgatgaacaatcgctcctgaagcacgtactgccggaagatttgctttctttcgggctgattccagaattcatcggccgtcttccggttattgccactttggaacaattggatgaagaagcattgattaagattttgaccgaaccgaaaaatgcgctggtcaagcagtacaaaaaaatgttggaactcgaccatgtagaattggaatttgaacaggatgcgctgaaggaaatcgcgaaaaaagcgatcgaaagaaaaacgggtgcacgcggcttgcgttccattattgaaggcattatgctcgatgtcatgtttgacttgccgtcccgggaagatattgaaaaatgtattgttacaaaagaatccgtcctggacaaagaattcccgaggctcgtgctgaaagacggcacagtcattgaaggcagcgaccagacaaaatcggcataaataagcggagccgggctgcccgccggcaatccggcgtgaacattcttttttgaacaggaaccggtctaaggcagcagggctaaattcctggtattggcacagcgccggaaaaatgagaggcgaagcagaataaagaagcaatgggcgagcggtgcgcttgcccttttttcttccgcccagccgttcctggttttcagaaatccccgtttattccctccggcagccggagatactaggtaaataaggaagcggcatgatcaggctgcaactgaaatgcttggagggaacaggatgaattggacggggattgccttattgatccagctatttttcgggatcattatcgggctttacttttggaacttgctaaaaagccaaaaaacacaaaaaattacgatagaccgcgaatcaaaaaaagaaatggaacagttgcggaaactacgggaaatttctttatctgtgccgctttcggaacgcgtccgcccggcagcattcgcggatattgtgggccaggaagacggcattaaagcactgcgggcggcactttgcggcccaaacccgcagcactgtatcatttacgggccgcccggtgtcggcaaaacggcagcggcccggcttgtgcttgaggaagctaaaaaaaatccgaaatccccttttcaacgtgacgctgtttttgttgaactggatgccacaacagcccgctttgatgagaggggcattgccgatcctttaatcggttccgtgcacgacccgatctaccagggggcgggcgccatggggcaggccggcatcccgcagccgaaacagggtgcggtcacctctgcccacggcggcgtcttgtttattgatgaaatcggggaattgcatccgatccaaatgaataaattattgaaagtactagaagacaggaaagtttttttggaaagtgcgtattacaatcccgaaaaccgggaaattccacatcatatccatgatatttttcaaaatggactacctgcagatttccggctgatcggcgcaacgaccagaacgccgaaagaaattccggctgccatccgttcgcgctgcatggaagtgttttttcgcgaacttgaccgtggtgaaattaaacaggttgcaaaaaaagcagctgataaaatccatatggcaatcagcgaaaatggcctggacattttggcgcaatatacgcaaaatggcagggaagcggtcaatatggtgcaaattgctgcagggcttgcaatccaggaaggacaggattttatccgggaggaggacctggaatgggtggcaacagccagccagttgtcgccgcgctatgagaaaaaggcccctgaacagccggctgcagggcttgttaacgggcttgccgtaaccggtccgaacacagggatgctgcttgaaattgaagtagcggccattccggcaaaagaaaggggcagcgtcaacattaccgggattgtggacgaagagagtatcggcggcgaagggaaatcggtccgcagaaaaagcatggcgagaggttccgccgaaaacgtcattaccgttttacggacgatgggtgtacccgctgaccagtatgacctccatgttaattttccgggtgggattccggttgacggcccttccgccgggattgcgatggcatgcggcatttattccgccatttataaaattcctgttgaccagacagtagccatgacaggggaaatcagcctgcacggcaaggtcaaaccggtcggcggcgtgtatgccaaaataaaagcagcaaaacaggcaggagccaaaacggtgatcattcctgccgaaaacatgcaggcctcgttcaaggaaatcacaggcattgcgatcgttccggtccggcagctggaagaagtcctggatatcgcattaaagaaacattttaacgacaatgcgctcatagggggttaatggacaggccccctaaaagacgtatcaagataggggtgctgagatgacaacacaatccgcatacacaattcctttgcttcctttacgggggattcttgtgtatccatcgatggttttgcacttggacgtcggccgggactactctgtccaggcccttgaaaacgccatgatgcatggcagcgaagttttcatgacgacacaaaaagacgtttccatcgaagaaccaaaacaggaagatttataccaaaccggaacgctcacaaaagtgaaccagatgatgaaactgcagaacgggacgatccgggtgctcgtggaaggcgtgcggcgcgcaaaaatcgtctcttttgaagatgaaggcaccttttattccgtcgaagtcgaaacatttgatgagcagtttcggccggatgctgaaacggaagcgttgatgcgcacgatgctcgaatttttcgatcagtacatcagccagtcgaaaaaaatttcgggtgaaaccttccaggcggtctccgatatggaagacgggggcaaggcggccgatattatcgcatcccatttgccgctccgccttccgcaaaagcaggacattctcgaaacgattgatataaaagaaagaatacgaaagctgatcgggctgatcaaaaatgaacaggaaattttgcaacttgaaaaagaaatcagccaacaagtgaaaaagtcgatggagcggacgcaaaaagaatattatttgcgggaacaaatgaaagccatccagaaagaactcggtgataaagaaggcaaaacggcggaagtgcatgagctgcgcgaaaaaattttaaatgctggcatgcccgagcatgtggccaataccgcgttcaaagaattggaccggtatgaaaaaatcccggctgcctcgtctgaaagcgcggtgatccgcaattatttggactggctgatcacgctcccgtggtcgaacgctacggaagatgatctcaacgtcgcgaaagcggaaaagattttgaacgaagaccactacggccttgaaaaagtaaaggagcgcgtccttgaatacttggcggtgcagcagctgacccggtcgatcaaggggccgatcctttgccttgccgggcctccgggtgtcgggaaaacgagcctggcacggtcaatcgcaaaatctttgggcagaaaatttgtccgcgtttcgctcggcggtgtaagggacgaatcggaaatccgtggccaccggagaacgtatgtcggcgcgatgccggggcggatcatccagggcatgaaaaaagccggcacgataaatccggtttttttgctcgatgaaatcgataaaatggccagcgactttcgcggcgacccctcagccgcaatgcttgaggtgctcgatccggaacagaaccatgcgttcagcgaccattttattgaagagccgtatgatttgtcgaaagtgatgtttattgcaacggccaacgatctgtctggggttcccggccctttgcgcgaccggatggaaatcatttcgatctccggatatacggaattggaaaaaattgaaattgccaagacccatctgctccctaagcaaataaaagaaaacgggcttgctcgcaatcagctgaggatggatgcggaagccctccgcctgatcgtgcgccgctatacacgcgaagcaggcgtgcgcggcctggaacggagattggccgaaatttgcaggaaaacggcgaaaatcatagtatcagggaaaaggaaacgggtcacggtctcagcaaaaaatatcgttgactttctcgggaagccgcttttccattacgggcaggccgagatggaagaccagattggcgtagcgaccgggcttgcctacacgaccgtcggtggcgatacgcttcagatcgaagtgtcgctttcaccggggaaaggaaagctggtcctgaccggaaaactcggtgatgtgatgaaagagtccgctcagaccgccttcagttttgtccgctccaaagcggaagcactcgggcttgcgcctgatttccatgaaaagtatgatattcatatccacgttccggaaggcgctgtgccgaaagacggcccttctgccgggatcacgattgcgaccgccctgatttccgcactgacgaagcatgccgtgcataaggaagtcgggatgacaggcgaaatcaccctgcgcggcagagtactcccgatcggcggattgaaggaaaagtcgctcggcgcacatagagcggggctgaagaaaattattattccgaaagaaaatgagagagatttggatgacattccggaaagcgtgcgtggggatctccatttttacccggtcacgcatatggatgaagtcattgaaattgccattgcaggtgaggagaaatgaaagtaacggaggcagaactggtcatcagcgcggtgcggcaggagcaatatccggaagggcatttgccggaaattgcgcttgccggacggtcaaatgtgggaaagtcttcctttatcaataaaatgatcaaccgcaaagcccttgccagaacctcttccaagccggggaaaacccagacgctgaacttttacaaaatcgaaaacaaattatactttgtcgacgttcccggctacgggtttgcgaaggtgtcgaaaaaagaacgggaaaaatggggccggatgattgagacgtacatgacgtcaagaaaacagctgaagacggtcgtgctcattgtcgatgtccggcatccgccgacaaacgatgactgtttgatgtacaattttttaaagtactataaaatcccgtgtatcgtcgttgccacaaaagctgacaaaatcccgaaaggcaaatgggcatctcatttgaaaacagcaaaagaaacgctgaatctggaaaaagaagacgaaatcattttattttcatctgaaacaggagagggaaaggacaaagtgtgggcttccctgatggaaagaattaagtgaataaagcccggggccagcatgcgggcaccgggcttttctgcaggatccggatctaaaatcgtattttttagcggtccggccccggaaaatgccggtaatgagcgcctggttgtttttttgggcgcgcggggctgtttgggtacttggcttttcatgccggactgcacgggcgggtgttatttccgcccccttcttttcgcaaacagcaggtagacgccgattacgacaagcacggccggccagaaattgatcagggaagaaacattgttttcgacaaggccgaaccatcccattactttatcggaaaacaggagcaatatggatagcacgagaaacaacagcccgtaaaacgtgccgtccccggttttttgcgaacggagcaaaaagccgatggcaataatgagaacaaagaccccgatattatccggccaaatggcgattttgccggcaaggtggaagtggaggccgaacccgacgagaatgacccccggcaaaattgattccccgtctcggccccagtagccttcgcctaaaaaagcgagcccgacaatgatcaacagcgtcggccatgtaaagtagtccttcatgccggtgaggtcaaaacgctgcaaataaaaatacagcccgaacccgatcaggataatcgcggaaaaaattttgcggcttttcaatgggacacacttctttccttcaatctagatgcttgaaaccatcgcctgtttctgctattttacaggtaggaatggtattatttcaaaagagaaaaacgagcttttttcttctattcatcttaacatagatcaacattcaatcctatgcatttggcaagataaaatgggggtgccggagggcaacaatgagaatacttactgtcggattaaattataaatctgcgccggttgaaatccgcgaacagctgtcgtttgatgaggcggaactcgcggatgcgatggcggcgctgcaaaagaaaaagagcattttggaaaatgtcatcgtgtctacatgcaatcgtacggaaatttatgcggttgccgaccaggcacacaccgggcgttattatattaaagattttctgtcagaatggttcggaatagataaggaagcatttgccccctatctgtttatttacgaagacaacgaagccattgcgcatttgtttaaagtgatttgcgggcttgactcgatggtgctcggtgaaacgcaaattctcgggcaggtgagggacagttttctgctggcccaagcatccggttcaaccggcaccatttttaaccgcctgttcaaagatgcggtcacactagcgaaaaaagcccatacggaaacggaaattgcttccaatgctgtttcggtcagttatgcggctgtggagcttgcgaagaaaatttttggcgatatggctgataaaaaagtggtcatcatcggcgccggcaagatgggcgaactggctgcggaaaacattcacggcagcggtgccacccggattaccgtcatcaaccggacgccggaaaaagccgggcttcttgccgcacgcttcgatggcgaggcactcgggctggcatctttggaaacggcgcttttggatgcggatatcgcgattacctccacttcggcaaaagggtacatccttacagcagacaagttaaaacccattgaaaagaaacggaacgggcgcccactgctgcttgtcgatattgccgtgccgcgcgatattgatccggaagccgcgtcccttgaatccgttttcttgtatgatattgacgacctggaaggcatcgtggaagccaacttgaaagaacgcgaaaaagccgcccggcagattgcggacatgatttccgatgccgtttgcgcattcaatgaatgggtccatacactcggggtggtgccggtgatcacggcgctcagggaaaaagcgctcgcgatccaggcggaaacgatgaaaagcattgaacggaagctgccggacttaacagaacgcgaacggaaagtcatcagcaaacatacaaaaagcattattaaccagatgctgaaagatccgattctgcaggcaaaagaaatggcgggttcgccggatgcagcccggaatctagaactgttccgccaaatttttaatttagaaacagaaacgggacaagcggaaccggcagccgaaatggcgcggcatgcagtccgcccgtcctattcgggttaaccggggagcccggcaatgtatgccgtatggacggacagactgcatgaaggcatgattttgctttatgcagccagtattttgctttattttcttgactttctccaccggaaccggaaggctaacaaggctgccttccgttttctttccgttgtctgggcattgcagacggttatatttattttgtacatggctcacaccagacggttcccggtcttgacattgtctgaggggctttatttttatgcatgggcattgctgacgctgtctctggccctgaaccgcctgctgcgcgttgactttaccgtgttttttacaaatgtcatcggcttttttatcatgacggtccacgcttttgccccggagaaggtctcacaaggggcaggaagaatggtatcggaacttttgctcatgcatattacgatgacgctgattgcttatgtgctgttttccctgtcctttgtcttttccgttctgtatttattacaatataagtggctgaaggaaaagaaatggagccacagaatctggcgcctgaatgaccttgcaaaactggagcggctttcgaaatggatgaatgccattgcggtcccggtccttttgctcgggctgattctcgggctatggtgggcatacttgcggcttccggccattcactggcttgatccgaaaattgtcgggtcgtttgtcgtgctgcttgtatacagttttctcctgtatgggggcgaacgccgccacatgttcggaaaaacactggcttattggaatatggctgcttttttaatcattttgattaacttttttctaattacaggattatcggattttcatttgtattattaggaggattgccggatgagaacaattgtcgtagggtcgaggcggagcaaacttgccctgacgcagacgaaatgggtggtggcgaagcttgaacagctcggactgccttttcgttttgaaatcagggaaatcaccacaaaaggcgataaagtgctcgatgtcaccctgtccaaagtcggcgggaaaggcctgtttgtgaaagaaattgaagatgccatgttgaatcatgaaattgacatggctgtacatagcatgaaggacgtgccggctgtgcttccggacgggcttgtgatcggctgcattccggaacgtgaagatgtccgggatgccttgatttccaaaaacggcacccctttttccagccttaaggaaggggcggttgtcgggacaagcagcctccgccgcggcgcccagctgcttgctgtaagaagcgatatccgcattaagtctgttcgcggcaatattgatacaaggctggaaaaattaaaaaacggggattacgatgcgatcgtcctcgcggcagccggtttaaaacggatgggctggagtgcggataccgtcaccgaattttttgatccggatatttgcctgcctgcaatcgggcagggcgcgctcgctgtcgaatgccgcgccgatgacggggaactgctcgatgcgctccggaagctcgacagcgcagaaacggcggaaacggtaaaggcggagcgcgtcttccttgataaaatggaaggcggctgccaggtaccgattgccggccttgcgaagaaaacggcagaaggcatttccctcactgcccttgtcgcttcccctgatggcaaaacggtatataaagaaacggttgtctcccacaacccggtaacggccggagaaaaggcggcagatattttaagccggcaaggggcaaaggcgctgattgaacaagtgaaagcggagctcgggcagtcatgacggcaaatgggcctttaagcgggaaaaatatcctgatcacaagaggcggaaaagacggcgaaaagctcgccgcacaaattgaagcgctcggcggcaccccttttgtcgtcccgatggtttccttccgtgcatatgccgacctgtccgcatctgtatttttgcgaaaactctcggcatacgactgggttgtgtttacaagcaaaaacggggtccgttattttttggaagcatgcagccgtgcgggtatagcatgtgagcatttgaacataaactgggcagctgtgggaaaaaagacggctgcctgtatggaacagtccggtttaaaggtttcttttgcgccccggaagtttacggcaaaagattttgcccgggaatttttgcggagcggacaccgggcaagccgcgtccttctcccgaaaggaaacttggccgggacagaaattgcggattttctaagaaaaagcggtataatagcagaggaatggattgtctatgagacgtatatgccggagggggcaaaagaaaagcttacccgtttgctcgggcgggagcacatcgattttgctctgtttttaagcccgtccgccttccgccattttaaaggcgcgcttgaagaaagcggcatggatatcgctgggctttcaacccggatcgcagtcatcggcccttcaaccaggcaggcagtggaaaaagccggcagccgtgcagcggtttgcccggatgaatacaccgtcgaggccatgcttggggcattatgcgattttgtccgtttagaagaaaaatagatagaaaccggcacgaacccgggattgaagcggccggcctaacaaaccggctgccatgtacggttttctccgagagattaccagccgggcgatgttcgacacgaagaaaacaaaatagaaaaagcgggatttgcccgcgaccgtcgcaatcattcccaacaagccggcagctgtgcatacttcccggataaatatgcaatacattgcggcattctaccagtttaggaggaaataaaatgaaagatttacagtttgcccgtcaccgtagacttcgccaaagtgccaatatgcgggctttggtgcgcgaaacgaatttaacagtgaacgacttgatttatccgatttttgcagttgaaggcgaaaatattaaaaatgaaattgcttcgatgccgggtgtgtatcactggtcgctggaccggctccatgaaatcatggatgaagtcgtttcccttggcattaaatccgtcattttattcggcgtaccgaaccataaagatgcaaccggaacggaagcgtaccacgatcacggcatcgttcaggaagccatccgtttcatcaagaaaaattacccggatatcattgtgatcgcggatacctgcctgtgcgagtacactgatcacggccattgcggcgttgtggaagatgggaaaattttaaacgacccaagccttgacctgcttgcgaaaacggcggtcagccaggcaaaagcaggcgctgatatcattgctccttcgaatatgatggacgggtttgtcaccgcgattcgcaaagggcttgatgaagcaggctttgaagatgtgccgatcatgagttatgcggtcaaatatgcatccgcgttttacggtccgttccgcgaagctgctgacagcacacccgctttcggggaccggaaaacgtaccagatggatccggccaaccggctcgaagcattgcgtgaagcacagtcggatgtggaagaaggggcagattttctaatcgtaaaaccgacgctttcttatcttgatatcgtccgtgatgtgcgcaatgaattccgcctcccggttgtcgggtataatgtgagcggggagtattccatggtaaaaggcgccgcacaaaacggctggattgatgaaaaggcgattgttcttgaaatgatcacaagcatgaagcgtgccggctgcgatctcatcattacctatttttcactcgatattgctcgctggcttgcggaataaacgggaggttgaaagatgcgctcatatgaaaattcaatcgaagcatacaaagaagcggtcacattaatgccgggcggggtgaacagccctgtccgtgcctttaaagcggtcggcatgaacccgatttttatggaccacggcaaaggcgcaaaaatttatgatattgacggaaacgaatatattgattacgtgctgtcatgggggccgctcatccttggccatgccaatcctggggtcgtggatgcgctgaaaaaaacggccgaaaaagggacgagtttcggcacgccgacgatcatggaaaataaactggcgtcactcgtgaaagaacgcgtaccgtcgattgaaatcgtccgcatggtctcatccggcacggaagccacaatgagtgctctgcgcctagcaagaggttatacaggccggaataaaattttaaaattcgaaggcagctaccacggccatggcgattcgctcctgatcaaagcagggtcgggcgttgccacactcggtctgccggatagccccggcgtgccactcggaatcgcgcaaaataccattgccgtcccgtacaatgatctggaagccgtccgatcggcattcgagcagtacggagaagatattgcctgcatcatcgtcgaaccggttgccggcaatatgggcgttgttccgccgaagcccggctttttgcaagggttgcgcgaagtcacatcagcatacggcgccctcctgatctttgatgaagtgatgaccggtttccgtgtcgactatcactgtgcacaaggctactttgatgtaacgcctgatttgacctgcctcggcaaagtaatcggcggcggccttcctgtcggcgcatttggcggacgggccgacattatggaaaaaatcgcaccgaccggccctgtttaccaggcaggaactttgtccggcaatccgcttgcgatgacggccggatatgaaacattgcggcagttaacacctgaaacgtatgcggaattcaggcgaaaagccgaccgcctcgaacaaggttttcatgaggcagcggtgaaatacgatatcccgcataccattaaccgggcaggatcgatgattggcatctttttcaccaatgaagaagtcaataattttgcatcagcaagcacttcggatttggatctgtttgcccgctactaccgcggcatggcggaaaacggcattttcctcccgccgtcccaattcgaaggcatcttcttgtccgccgcgcatacggacgaggatattgaccgtaccgttgaagcagcagaaaaaacatttaaggcaatccgcgggtaatcctgcggctatgaaccggcaagtccaaaaatggatgagccggttttttttgcgttctgtccgctgcgggcgagagagaagtagcagtagggaaaatttcacgctctgtgggtggcccgatggtttttgaacggatcactccgaaaacggatggccgaatcagttcgcctagctcgaccaaatctaagtttttgaacgggtaacctgaaaacagatgagccggtttttatcgatttctctccccgtccaatattgttgcgaaaaagccattcaagtgatttacggatgctgcggtttatttgcgatcataaaaaccccgattgcttcatacagtgtaaatgacatattcattgggatttggaggaattgaagggaggaacccgctttgccgcaaaatcaatcgtccatacgattttcattagaagaattgatttggtttaaaaaaggacaggaagttgaagaacttttatcaatatcattggatccccatatcaccatacaggaattggagcagtatgtcgtgatcaaaggcaatctctatttggccggggagtatatcggttgcggggaagaagaaggggaagatgtgctgttcaggaagtatgtgcaggcggtccagtaccgggaagaagacggcatatttgaattttaccaatctttcccggtagacgttaccattccgaagacaagaattgcggatattgaggaactggacgtcaatatagaaggatttgactatcaatttcacggaaccgattgtttaaaaatcaatgcggatattgcgattgagggaatattgcaagacggggatgaggaagaggacgaagccgaaacagcaccatacccggatttgaacggccgggaaacctatttggatgagccggacgcagcatatcaggcgccttttagccattccgagtggagtttatcggaacaagaagaagagagcaccgaaccgccccgccattttatggaagaagcggaaagctttgaagaagtgcctttgcgtgcagatgaggaaaaagaagaagaggatgaatctcacgctgacccggaattgtatacaccttttacgatcgaatcgcgcgtggtgccggaagaatcggttgctcagccggaaccgtacacaaacgaactgaatgtgctagcaccggtcgaactgccggaagaagaagaggagagtctcttgccggaagcaggcggaaaagtgccggaaagtgcttcatggcaggcggaaacagccgcgccggtacgggatgaatggcatgcggaaccggagttttccggaaaaaatgagtctgcatcgttggcagaaagcgaactggtacagaatgagtggcatcctgggccggagtttccaggaaaaaatgagtctgcatcgttggcagagagcggagtggtgcagaacgaatggcatgctgaagcggatctttcaggcaaaaatgtgtctgcatccatagcggaaagtgaaccggtgcgggatgagtggcacgctgagccggggttttccggcaaaaacgaatccgcatccatagcggagagcggagtggtgcagaacgaatggcatgcagaaccggagttttcaggcaaaaacgagtctgcatccatagcggaaagcgtaccggtgcggaacgaatggcaggccgacccagtgcgggatgaagggcatcctgaacaggaattgtccggaaaaaccgcatccgcgttccggacggagagcaaaacggctctgaacgaagaatctcttgagccggatgacgccgggaagacggagcccgttttccggatcgagagcaaggcaatggaagatgaatcttctgcttatctcaagcaagaatcgcctgaaaaagatgaatcttcttctgtggcgagcagcgaaacgattgtggaagagtcgccggaaagcggggagaaaatagaggaagtgccggaagaaaaggattcggctgccaagaagaaaaagaagcaaaaatacgaatctatttcgcttgccgacttttttgcccggagagatgaagaaaagcctgccaagttaaaggtttgcatcgtccaaagcggggagacgctcgaccagcttgctgaaaaatacaatatcaatgtccagcagattttaaggatgaaccatttggaagtgaaccaggatgtatatgaggggcaagtgctgtacgttcccgcaaacgcgcgcgccgaaaaaaatcactgagccggagcattcacaggcacgggcgtctaggtgaaggatgcatctgaaattcaggggctaagcgcctgcgtaaggaagcgtgcaaaacgagctattcttaacctagattgcgcctatgttcaagccgcggcgaatgcggcgcagcgggggaatgaaaatgagcaagcgcctatttttcaggagaagcgctctaagaaggtgaaacgggtgactgacctttcgcagcaggacatcaatcggattgtaaagcattacggcctgaacgctgaatatgtcgggcggtacggaaaagtgtataaaatttataccggccagggcatctttgctttaaaaaaaattgcaccgcaaaacgggatgggatttatccggcatgtccagtctctgtaccagcggggatacaaccgtattgtcccggtctatcccgcgttggacggccgttacggggtgctgtataacggggcattatactatttaatgccctggctgccaaacgaagaaaaagaagcacgcggcgagaaacatcaaaaaatgttcagggaactcgcacgcctgcacagcttgtccgtcaaagatacggagatctcaatagaaaaacggcgggaatactatgaagaaaccctttcccgctggtacgggcagcaggattttttggaagagttccttgaacggtgtgaagagcaggtctatatgtccccgtttgccctgttgtactgcaccttttacaatgaaacgaaccaggcgctcaaattttcgatccggcagctggaaaactggtatgaacaatcaaaagagatggagaaagcgagaacggtgaccatccacggaaaaatttcaacggagcattttttgtacgatgaacgcgggctcgggtactttaccaatttcgaactggcgaaaaacgctgcgcctttttatgacttgcttcccttcttgtcgcggacgctcgattcctatccgagccggtttgacgactgcgtggattgggtgaagacctatttcagctattttccgctgaaagaagatgaaaaaagcttatttttcagctatctcgcttatcccgcaccgatcatccaaaccgtggaggaatactttgcaaatgaaggaaaacgccatgaagcgagagcagtcgcgaaactgcaggaaaagtactggcgaatgaaaaataccgagtatgtcgtcatgcagttgtcacaaggggccgcccccgcgtcatgaaaagcaggaacggccactaaaaccattcatactgaaacccgagataaatgagaataaatatggcaagcagcaaaacgtcaaacgtcgtcggaaaaataatcgtacggatggcctgaaagacggagaacggaagaatcagctgcttgcacactttttttgcattccgcgcccatgtacggacggcctgtttgtcaatttttttcttcatcatcatccacctatccctcaaaaataatgtatgaaaagcgggcggatcagtgcatccgccgcatattttttctaaaaatgggcaatgctattgacgattttcacaaaaaccgataccataaactatagtcaatttcaaaaatcaaagtacaatgaacgggaagagtacagattttgtttccatgcagagagggaaatcagctgctgaaagatttcctatgcgaaacaggctggaaggtcgcccgggagtagcttttgtgaaaccgaaagtagcaaaagccggcgaagtgccgttactgacccgagagtgccgggcatccgtttgcccgtgaaaaaaggtggtaccgcgaacagactcctttcgtccttttatggcgaagggagtttttgtgtttatccgtaaaagacgcagaaaggaatgatgcaaatggaacagcaggacatcagcatgccgaccaaatatgatccgcaggctgttgaaaaaggacgctatgaatggtgggtgaacggcaaatttttcgaagcaaaaggcgacccggaaaagaaaccgtacacgattgtgattccgccgccgaacgtaaccgggaagctccacctcggccatgcctgggatacggctttacaggatattttaacccggatgaaacggatgcagggctatgatgtgctctggctgccggggatggaccacgccgggattgcaacgcaggcaaaggtggaagccaaactgcgtgaagaaggcaaatcccgctatgacctcggccgcgaaaagtttacggaagaagcatggaagtggaaagcggaatacgctcaatttatccgcaaacaatgggcaaaacttggccttgggctcgattattcgcgcgaacgttttacgctcgatgaagggctgtcaaaagctgtaaaagaagtatttgtttcgctttataaaaaaggcttgatttaccgtggcgagtacatcatcaactgggacccggaaacgaaaacggcgctttccgatattgaagtcgtctacaaagaggtgcagggcgcattttaccatctggcatacccgttaagcgacggttccggcacgatcgaaatcgcaacaacgcgcccggaaacgatgctcggtgatacggcggtcgctgtccacccggatgatgaacgctacaaacatttaatcgggaaaacgattgtattgccgatcgtcggccgcgaaattccgattatcgcagacgagtatgtggacatgacatttggttccggtgccgtaaaaattacgccggcccatgacccgaacgacttcgaagtcgggaaccgccacaatctcgaacgcatccttgtgatgaacgaggacggcacaatgaatgaaaatgccggaaaatacaaagggatggaccggtttgcatgccgcaaacagattgtggaggacttgaaagcactcggcgttcttgtcaaagtggaagaccatctccattcggtcggccattccgaacggagcggcgcggttgtcgaaccgtatttgtcgacgcaatggtttgtgaaaatgcagccgctcgctgatgccgcagtaaaactgcaggcgtcggaaggaaaagtccattttgtgccggaacgcttcgaaaaaacgtacttgcactggatggaaaatatccgcgactggtgcatttcgcgccagctctggtggggccaccggattccggcctggtaccataaagaaaccggcgaagtgtatgttgacaccgagccgccccgcgatattgaaaactgggaacaggatccggacgtgctcgatacgtggttcagctcggcgctctggccgttttcgacaatgggctggccggatgaagaagcggaagactacaagcgttattatccgaccgatacgcttgtgaccggctatgacatcattttcttctgggtatcgcggatgattttccaggggcttgcgtttaccggcaaacgcccgttcaaagacgtcctgatccacggtcttgtccgcgacgagcaggggcggaaaatgagcaaatcgctcggcaacggtgtcgacccgatggaagtcatcgacaaatacggcgcggactcgctccgctatttccttaccaccggtagcgcaccgggccaggatttgcgtttcagttacgaaaaagttgaagcggtctggaatttcgccaataaaatttggaacgcctcccgttttgcactcatgaacatgaacgggctgaaatacgaagaaatggatctgtccggtgaaaaatcagtcgctgacaaatggattttaacgcgtttgaacgaaacgatcgaaaccgttacaaaactggcggacaaatacgaatttggcgaagctgggcgcgcactttacaattttatctgggacgatttctgcgactggtacatcgaaatggcaaaactgccgctctacagcgaagatgaagcagcgaagaaaacgacacgctcggtccttgcgtatgtgctcgacaatacgatgcggcttttgcacccgttcatgccgtttattaccgaggaaatttggcaaaaccttccgcatcagggggaatcgatcacaacagccgcttggccggaggtggacgaaagccttacagatgcagcggctagcgaagaaatgaaactgcttgtcgacatcatccgttccgtccgcaatatccgcgcggaagtgaatacgccgttaagcaaaaaaatcaaactgcatttgaaagcgaaagacgaaacggtcttagcggctttaaaacgaaacgaagcgtacattacccgtttctgcaacccggatgaattgaaaatggggcttgacctcgaggcaccggacaaagccatgactgcagtcgtttccggcgttgaactgttcctgccgcttgaaggactcattaattttgaagaagaactggcccggctccggaaagagttggcgaaatggaataaagaagtcgaacgcgtccagaaaaaactgtccaatcaagggttcctgaaaaaagcgccggaaaatgtcgttgccgaagaacgggcaaaagaaaaagactatcttgaaaaacgaagcaccgtcgaagcgcgcatcaaagaacttgaaaaccagtaatacaagggtggaaggcgaattctttacggattcgtcttccttgcatacgggaggaaaggcatatgtttgaaacctatgaagaagcggtcggctggatccggtcccgctcgaaattcgggatgaaaccagggcttgagcggatgcagtggctgatggaaaaattgcaccacccggaacaaaaaatccggacggttcacgtggccgggacgaacggcaaagggtcgaccgtcacctttttgcggaatattttagagcaggcaggctatacggtcggcacctttacttccccgtatattgagcagtttaacgaaaggatcagcataaacggaacgccggtgtcagatgcagacctcatccggcttacaaacgagatccgcccgcttgcagaagaactggagcacacagcattcggcgcaccgacagagtttgaagtcattacagcgatgtcgcttgtgtattttgccgacatccggccggtggatatcgttatttatgaagtcggccttggcggcaggcttgactccaccaacgtcatcacaccgcttgtcagcctgattaccaatatcggccatgaccatatgaatgtgcttggccatacgattgcggagatcgcatttgaaaaagcgggcatcatcaaacacggggtgccggttgcaacgacagcaatgctgcctgatgcgctagcggtgattgaagaaaaagcggcaaaagaaaaggcaccgcttttccgtgccggaaaggaattttcttttgcggagattggtggggatctaactggtgaacatttccgctttgcttctccgtacggcgcctatgactgcttgtcgatcgccatgatggggcgccatcagatttacaatgccgcgcttgccgttatgggggcagaactgttaagacatatccaccattttcgcatcccgcagcatgcactggaaaaaggccttctcctcagcaagtggatcggccgatttgaaaaactgctggatgacccgctcgttatcatcgatggcgcccacaacccggaaggcattgacagcctgatcgaaacaatggacacccatctgcgcgggaaaaacattcacatgattttttccgcacttggcgacaaagacttggatcacatgattccgaaactcgaccacaaaacagacgaaatcattttcacaacttttgattttccaagagcgattccggcagagatgttgtataagataagccatcatcaaaataaatcattttcggaggattggaaagaaaccgtacttgctaaaataaaagaaatgaaaggctcaagagatgttttagtcattacggggtctttatactttatttcgaaagtccggaaatacattttgggccaatcagaaaggaacgggcagagctgaaaaagttctgcccttttttttatttgttctatttgttgaattactttcccggcgctttttgataaaataagttttataggaaataagacgcaggacaaaatgcttagcggaggttgttatgaaaaaacccctttttaaaaacaaccggggatttacacttgtcgaagtgctcgcttcgattacgattttagcgattgtgatgctcacagtgggttccattttggccaataatgcgggcgtgacaaagaaagcggatgactcgctgtctgcattgcaaattgcaaccgggatattaagagcttaccagaaaaaaaactttaatgaagtgcagcaaatggcgaacaccacacaacaagctgatattcaatcggttttagggcttgatagcgctgcggaaatttccggttataaggcatatgtgtccgtttcccttccggcggattcttccctttctgaccgcctcctgctggtcaaagtaaaagtcgacagtggaaatcatctaaaaccggttgaagtgaaagggtatgtgaaaagatgaaatgccggaatgaaaaagggctcactttagtagaattactggcggctgttaccatttcatttatgatcatcggggtcatttatgccgttttaaatacggtgatcacccaatccaaaagcgacatggcacgtaaaaattttgtcaaagaacaaacggctattttacaatacatgaacagcgcaatggaaaatgtggacgacattgaacctgatgacgaaaatgatgacgggacttttacccgtttcaaagcagtggatgtcaatataaatgttggaagtgacggcacctaccaggaaagttcaactgacaagacaatcactgtatcagacgggaacttgtcggtaggaggcacgattgtaaacagcgatggaatttcacttgacgggacaacttttacggttgagaatggcagcctgatatgccattttgtaatgaaagacacacaaaatcattttgagaaaaagatctatgccgcttataaactgggcgaagaggggaatccatgatgcatgttttaagagaagagaagggatatacgcttgtgaccgtccttctcattttcgcagtcgcggcgattatcaccgtttcactcgtatccgcatccgtcagtacttttaaaacagtaaaagtatctgaaacgggcacacaggataaattaaatgcggaaatggtagcggatgaagcgactgctttaattgagaaacaagttgacagcatcaatagtaccattgcgaacggtactgtcatgccaagccagctgatcagcatgcttcaggcagccataacgagcatacagcaacagaaaaacggcaaatgcagcatcgcatataaaacattgaaagacgggacagcaccagacggaattgttttgggcaaagtcaccataacagtgccaatcggaaagtctggaaaaacgttaacaaaggtgatgacgctttccactgtctcggacgtttttcaatatacagccgtgacgccgtcgaatatgtatttgtacgggtctccttatattatcggggatgtgaatatcggggggaatctgtatgtttcaaactacgggaactatgttgaggggtacacgaaatatattcaaacttactatccagcgatcaatgggacgttaacagtgaagggaagatattttgaggccgatcagcagccggtaggaacaggaacatcggcgccggtttacaacttttattcatggaagccatttggacctgaaagcttcagccgctacttttctgttgccccggttgtgaaaaatcgtcagttaacggttgacaaaataaatgtaggcgatatgattacagccaaggcgctgggatggccgggaaatttaaaaataaattcttacgattcttataatatagataagtatgggaacgcttttggttatgatgtaacagtcagccaggttggcagtcaaccaataaaaggaaacttgtacgtcggcgatgatttaaccgttggggaaaacaaaagcctgactgtaaatggagatctttatgtaaaagatgatttgactgtcaaaggaaatttaacagtaaaaggcaagatttatgtaggcggtggcgctaatttaaacggagtgctgtcgacaggggaaaatcagtatatttatattgccgggaatgcgacattgagtgaggtttcagcattgaatttaaacggggtgatgtatgtcaatgggtcccttacgagcagcggggatgtcaatacaaacggcagcatttatgtacgaggagacgcagatgtcgaaaatttctcgaacagtagtggcacgcttattttactttgtgatggaaatattaagttagccaacaataatttgtatgaagaccgtccaaaagtgattgatgcttatctctactcaaatcgtgacttgtttatatatggcatcggatcaaatttgaaaattaatgggggtatctatgggaatacgattggtttaagtgcatcaaggggctggacgataaataagttaatctatgaattgttaattttcaaaagatatgaattggaatttcaaaacccccagcctgcggatcatgtaaagtccagactcaccgttaattttaaaaaagatatgattttaaacccgccgaaagggatcccgacagtgaataaagtgactttgaaagaaatcaatacatcagtccagtaagagacaggtaaaaagatgcagtacaatcttcccattcgccatgatttataataaaatagtcttagttgattttcgacaattggtttttctgggaatattgtactctgatagaaacagaggtgggatgatggatcttctcactgcggcgtttgccgtaattggatttttatgcgtaatggcattttttgtctttttttctttcggcttttctaaaaaaggggtggttgtgctggccggctccgcttttttgctggcgcttttcggcattttggcgggcagtgtggttccgctatgggagagtggtttaattacttttttgctcgtaatttgtgtggcctatctgttcgaaaaaaagttggcatttttgttcgctggacaggataacgattcagacgaatttccagtaggggaggagcaggaagagatggcggtggcgcggaaaaatcggccggcagcactggtcttgcctgacgtaaatgccgctgttcttccggctgaaaaaagtgctccggccgctgaaacggaagagattttgccggagaaaaacgggccgggatctgaaacagaagggacactgctaaaacgggaagaaaaggatgaacccgaatgggaagaactggacgatactgcggccggaaatgaaacggaaaccgctcttccggcaaacgaacaggcggcagaacgctccggggaagaagaaattgattttcttgaaaaccgtctggagatgcttgaagaagcaaatgaagaaaataaggcggatcatttgccggaaatgtacgaagttgaagaatgggtggcggaagcggagagcccggatatcaaacctttggacgggacaaccacaggtcaagattccgaagtgattgcaggagaaggatcggtaacgttatccggttctaaagaggttcaatatgtggaacaagaagagatcccactcctttcttttgaaaaggaaacagaagcacctgctgaactttccgggacagacatgcctgccatggacgaactggaagaaatcgatgtgattcctttccgcgaaaccgacaatgccgggcaacgtgaaaagctgccatcagatgcggaaaatgaaacagttggcggtgcgaaaggtgaagatacaaacgagccggaagaaatcggtttggtgcctgtccaagaaactaattcaactgaacaatccgtaaatttagatctggatgcggcggatgaagcagccagcgggtctaagcgtgacagcacagacggactggaagaaatcgatgagattcctttccatgaaaccgacaatgccgggcaacgcgaaaagctgccatcagatacggaaattgaaatagttggcggtgcgacaggtgaagacacagacgaaccggaagaaatcgacgtgatgcctgacaaggaaaccggccaggtggcagagcccgaaaagttctattcggaagcgggccagggacgggaacgacaaggcgaaagcggcgcaggtacgggcgaaacggttgccgcaaacgaagcggaatcggcaggcaattctgtcggtgagaaagcaatggaaccgaaaggcaaccctgccgttgaggaagcatcggacactttagcatccgtgccaaacgggacaacgcctattcaaaagcaattgcttggggtactagtggaacaactgaacctttaccgtcttacgcagccggctgacgcgtacgaacagctagtgaaagcacatttgcatccgcagcttgcaccggaagattatttcacctttgcaagccttctggtcgaacattacatagctgaacaacaatttggcaagctgcaagtcctgctgaaagacttggcggaaacctatgcagaatacccggtcatccgcgaagaaatcgattttttaaggacaaaatacggtcaataatccatgaagaaacaggtgtgaggtagatgaaaaaaagcacgcaaattttgggccagccgatcatcagcatttctgaaggcgctgaaatcggaaaagtaaagtcttttgtcattaacccggacaaaggatccgtcgattttttaacgatcgaacacgaagactggcaagtaagcgtaaaagcaattccgttcaaaaaagtggtcgggatcggcgagtatgcggtcaccgtggaaagcgacagggctgtcatcgatttaaacgaaattccgattgcggaccagctcgtcaacaaaaaaattcgcattgtcggcgctaaagtgatgacacgaaaaggggagctagttggcgaagtaaaagaattttacgcagatgaaaatacaggcaaaattttaggggttgttttgcaaacaggcgagttggaaacgatcctttctgctgattttgtgatgacgtacggaagagatattgttgttgtgaaagaggaagcacccggccattttcttgatgatcctgaaaaactgctgacaaaagaagtagaagaagagcttgaacaaccgggcgaagagggaatggaggcactccgggcaaaacaagtggaacttttaaaaggaaagaaagcggtaaaagacatttacgcgggaaacggggaacaggttatcgcggcaggaacggttttgtctgaagaagacattaagcgggcacaggaggccggtccgggtgtttttgtcgagttgtctatgcatgttgatgaatgaaaggcggcgctgaagtgtgggaaacaagcggtatttaaaagtttttacgatcttattgatcagcacagcatttatattcagtttctcacattttggggctttggccattgcgaacggattcggacataaagaaaaatatgcgcagggcactatagccggaggaatacagctgtccgggctgacggaagagcaggcacagcaaaaattatcatctgccgttcagaaatggaaggcgtccaatccggtagaaatcgtctatttggcaaaaacggtgaagcttccggctgaacagctgcatttttccgtaacagaaagcatggttcgggtaaaaaacggcgaggccgcgccgcttgttgtcacgcttgaccataataggcttcgggacctggtctcaaagtcttttcccgacgtcagcccggatgacgtggatattgcccggctcgacatggccatatgccacgccgccgcccggcttgagactgccaatctttcctttgatttgtccggttatgccgtggacggaaatgaaaaagaaacgacagtatcaaaaggttcagtagcaaatgtttcgcttgcggaagcaacagaactcgaaaattgggcaaagcagtttccgcaagtcaacattcctgcgcacgggatgttttccttattcaaaacagcggaaaaaacaggcgcttcgttttcaaatgaagcactcagcatgattgcaaccgccatatacggggcggtgctgccgaccaatttcgaaatcattgaacgcaatacgggaaacgaactgccgtactatgcaacgcttggaaaagaagcaaaagtggtgaaaggcaagctggatttctcttttgtcaacccgaacccaaccgcttatcagttgaaattcacggttcgaaacggcgctttttccgtatctgtggcaggccggccttttctcgaaaactataaaatggtgctgaaagatcaaaaaacgattggccccgaaacaaccgtgcaatatcatcctgctttaaaagcggatcagtctgttgtcttgcaagccggaaaagcgggttattatgccaaggtattccgcaatatttacagccagaatcacggcctgctgaaatccgtgctgttggcggaagatttttatccgccagtggcacaaatcgttgcaaaaggcaatccggcacaagtggaaaatacggaggactcatcggaaacagataacggttctggtcatgaaacggacacgtcaacaagtggcagcagttcaaaaggcagcgaaaaaagtgccggcaaagagacttcaaaaagcaaaaaaagtgccggtacagaggcttcaaaaaagagcgaaaaaagtaccagtacaaaagctgagacttcaaaggatcgcgaaaactctaccagcacaaaagctgagacttcaaatgacagcaaagacagcaccggcacgcatgacggcaaggataacggggcagacagcaaaagctgacataataaagacccgggacatgacagataaagcgggggaattcggatgaagcaagtgcgaaaaaggcttggcgatttattggtggatgcaggattaattacagcagaacagctggaacaggtgctgaaggaaaagggggcgggccaaaaactgggcgatgcgcttcttcagcgtgggctgattaccgagcagcagctcattgaagcgctcgaattccagctcggcatcccgcacatcagccttttccgctatccttttgaccagagcatcatgaatcttgtgccgaaagaaatggcgaaacgaaatcttctcattccgctcaaaaaagacggggataaactgtttgtcgcaatggcggacccgatggattttaatgcgatcgatgacttgcggctatcgaccggcttccggattgaaccggcgattgcctccaaagacgatattttgcgggcaatccataagtattacgacctggatgacaatatggaagaactgctggacggcattgctgaaaaggaagaggcaaccgaaaccgcacccggggaagaagattcgcctgttgtccagctcgtcaaccagcttttgcaaaatgccgtccaaatgcgggcaagcgatatccatctggacccgcaggaaacaaaatacatcgtccgttaccgggtggacggaattttgcggacggaacgggtgctgccgaaatcgatgcaaagcgtgcttgtggcgcgcattaaaattatggcaaatctagatattaccgaacaccgcatcccgcaggacgggcgtattaaaattgacgtcgatttccatcccgttgatatccgggtatcgacgctgccaaccgtattcggggaaaaaatcgtgctccggattttggatctttcaacagccatccacgatatccgccagctcgatttcaacaaactgaatctcaagcgttttacgcagttgatccaccgcccgaatggcatcattttgatcacagggccgaccggttccgggaagtcatcaactttatatgcggccctaaaccatctcaatgatgaacaggtgaatatcattacggtggaagacccggtggagttccagattgaaggcgtcaaccaaattcaggtcaatccggcggtcgggatgacgttcggcaaagggctgcgcgcgattttgcggcaggatccgaatattatcatggtcggggaaatccgcgacaaggaaacggctgaaattgctatccgcgcttccctcaccggccatcttgtcttaagtacgctgcataccaatgatgcgctcggcacaattacaagattaatagacatgggcgttgagccgtttctcgttgccacctcactcagtggcgtcgtgtcgcagcggctcgttcgcaaagtgtgccgcgactgcgcagaagaacaggtgccgacaaaacgggaaatagaaatttttaaaaaacgcggcatcaaaattgagaaaatcattcgcggccgaggatgcggaaactgcaacatgaccggatacaaaggacggatggcgatccaggaactgctgatgatcaatgaaaacatccggcgtgggattatgaacggggaacctttatccaaattaagggaatatgcgatccaaaataaaacgatttttctgctcgatgacggattactaaaggtaaagcaggggctgacaacgaccgaagaagtgttgcgcgtcgccctaccggagtaggtgaaaggaatgaaggaaaaaattgaatacttgcttcgctcagcatttgaactgaaagcatcggatcttcacttatccgttggcgtgccgccgattctgcgtttaaacggccaactgaaacgttacggaaaagaagtgatgacgccgcaattgacggaaggaatggcaaaagcgatcatttccgataccatgtggccggttttccaggaacgcggggagcttgatttttcttacggcatcccgggcgtatcccgtttccggatcaatgtgtaccggcagcgcaactgcgtgtcgctggcgatccgtgttgtcccgactacgatcccgacagttgaagaactgcatttgccgcctgtattgtatgcattcacggaaaaaccgcatggcttagtgctggtaacagggccgaccggaagcggaaagtcgacgactctcgctgccatgatcgaccatatgaacaaaacgctgcacaaacatattattacgcttgaagacccgattgagtatttacataaacatcaaaaatgcatcattgaccagcgtgaagtcgggtttgacacgcaaaactttgcgaacggccttcgcgcggcactcaggcaggacccggacgtgattttagtcggggaaatgcgcgatctcgaaacgatccatatagcgattacggcagcggaaaccgggcaccttgtcctcggtacgctgcacacatcgggcgcgccgtcgacgattgaccggatcattgacgtttttccgccgtcccagcaggcgcaaatccgcatccagctggcaaatgttttagttggaattatttcacagcgcctctttccgacagccgacaacaaagggcggagggcggccacggaagtgctcgtcaacaacgcggccattgccaatctgatccgcaatgagaaagttcaccagatcgtgaatgtcctgcagacgagccgcgcactcgggatgcacacgcttgaaaccgatgtgaaggaattgcttgcagcgggcgcgatttccaaagaagcggcggaaccttatttacaggagattgtccaaaatgccacgatttaagtacgagggaaggacaaaagccgggaagaaaaacggcgtcgtcacggccgaatcgaaacgggaggcgctggtaaagctgcgcgggcaaggcgtccgcgtgctccaaatcaatgagatgccggaaacgttaatgacgatggaaatcagtctcggcggcagggtgaaactgcaggattttgtcattttcctccgccagttttcaacactgctgaaagccggcgtaaccgtcgtcgattctacaaacatacttgccagccagacgagcagcaaaacattaaagaaaacgcttttggccgttgaggaagatttgcgtggcgggattccgctttcccaggcggccgcaaaacataaaaaagtgtttaccccgatgttcattaatatggtttatgccggtgaagcgggcggcaatcttgacggtacattggaaaggctcgcaacctactacgaaaagcagcaccgcacaaggcaaaaggtaaggtcggcgctgacgtatccggcttttgtcggggtgatggcgattgttgtcgtcatttttatgcttgtaaaaatcgtcccgacctttgtatcgatgctcaaaaactataaagccagcctgcctgcggttacgcgccttgttttgtcggcaagcgggtttatgcagcactactggtggctcgtcgtgctgattttgatcggggtgtacgtgctgctggtcgttttgcgcaaaaacaaaacgagtaaattttatttggactatgcgatgctcaaattcccgattttcggcaaactcgtccaaaaatcgatcattgcccggatgacgcggacattgagctcgttgttttccagttccgtgccgattttacaggcattgtcgatcgtggaggcaatcgtcgaaaacgaagtgatgacaaaagtgctccgccaggcccgcgatgcgctggaaaaagggcagtcgatgacagaaccgatgcggcgccactgggtctttccgccgcttgtcacgcagatgattgcgattggtgaggaaaccggtgcgctggacgccatgcttggtaaagtcgctgacttttacgaggccgaagtagaagccgctaccgaccagatcaaagcgctgattgagccgtttatgatcgtcgtgctcgcagccgttgtcggcacgatcattgccgcgattatgataccaatgttcgaaatttataataatgttcaataaattgatcaaaaaaaggtaggattatgcaacacaaccatgtataatataggtaaaaagttctaggacattaggaggagaaacgatgttacacaagaaaagaaagttattgaaaaatcaaaagggctttacgttgattgaactgttggcagttattgtcattttggccattattgcagcgattgcgatcccggcgattggacacattattaagaattctcatattgatggggataaatcagatgcagttcaagtaataaatgcagcgaaattatatgtttcacaaaaaggaataccaagtgaagctttaagcatcactgaattggatccatacttagatgatgaggttaatctttctgaaattagtgtgtctgttacagaagatgaaacaacaggaaaagttacttatgctttaacggctaatgggaaatatgttacgtttaaaaatgctacgttaactgatattaacaattcgcctaaaggtgctactgaagtacctaaaaaataattttgagtaaccccatctattttccaaggcctgccctccgtgccaggccttggttactggtttttaagattgctatttaaggagccatcatgatgccacgctcattttttccatcatcgaaaaaaaccggaaatttcattatcaaagaccatgtcattcgttttctcgaattgagacagactgacccgcctgttgttgcaaaaatgggcgagcggtatttgccggaaggactgatccgcggcgggaaaattgctgatgccgagacgcttgcgatgatcgctgaagaatgtcttggtgattgggggctgaagggaaaacacccagttcgttttgctgtgcccgacaattttgttgtcgtgcgccaaattgctgttccggatgagattgccatggatgaaatggaaggttatattacccttgagctcggttccaccatccatttgccgtttgacgatcctgtatttgactttgcgctccttggtgagtcgaatcaggaaaagcaggtgttgttatttgctgcgccccgggatgtcgtcgaagattatgccggtttttttaacgatatccgcctgagcccggttgctgccgatatttccccgctatgcgcctaccggtctttttatcatttgaatacactgaatgcgatggaccatctgctccttctccagtttgatttatccatggtcaatgcgaccattttccaccggcatttcccgctgcttgccagggagcttgaagtcgatattccgctttccaaatgggagacggagaccaatgcttttggcgaaaaaaagtaccgctggccggaagacgatccactgctccgctaccagacggaaaatatttataaagagctggacagaatcatgaattattaccagttttcgatccggaaagggcaggatgcggtcaatcaaattttgctgaacggcgattatccgtatttgcccgaggttgcggacaatcttgcggagcagtttggcctgtcggtcaagatgatcgaaacggaaaaagtatcttccacaaccgggcagccgtttcccgcccgctttgcgcctgttttgggccttgcactgaaagaggtgaaataaatgctcgtcgagattaacctgctgccgaaaaaagaaccgaaaaatatcgcgctgctcttttggggcgggatactggccggtgcagccgccatttttgtcatcatcttctttatcgcgctccatcagacaaaacaggatcttgctgccgttaatcagcaaatcaaacagacggaagcgctccaggccgctgaacaggcagcacaaaaaagcaatgcggacatacaggattttaaaaagctctcgtccgccgttaaatgggcaagcgatacgccggtcaagacggtgccggtattggacaagcttactaaacttttgccggaatacggctatatcacggacttttcctgcagtagcacgggcgcgaatgtgaccgtccagtttgatgcgtccgatgaagcggtttacttcttaaaacggctgaatgacagtccgtatttcagcggcgccgtcttaaacagcatcaaagtaaatacggaaacggccagcgcttcttcaagcggcacatccgatgctgcaaccggctcagctgcgggaacgggcacaacatccggcacttccaaaacggcaagcagcacatcttccggatcagatgcgtccaaaacggccggcgaatcttcttcgggaacgtctaaaaccggttcctcttccacatctgctgcatccaaaacggccggtgaaacaaaggggggcggttcctcttccgaaccgggtgcaacaggtggcacagccggcgcggatactgcagcaaccggtgaagcagagggtgtaacggtttatgaagcgacatatacgatccagctcaatcaaactgcactcaatgccgctagcaaaaaggaggaacagcaatgaacctccgtttaaaccggaaacagctttttatcatgcttgccctctttgccgtttgccttgccggcgcattcggtttgtactggtttgtgctggcgccggctaagtccgagctggccggacaaaaagctgcattgaaatcggaacagcaggtgctatccagcctgcagtcaaaaaaacagcaaagcccggaactgcagcttggcaatgttgtcagcctgttgcggaaaatcccggcaaaaccgcttgcggaacaagtgctgcttcagttcaggatggcagaggccctttccggcagccggattacggaaacagacgcccagcaggactctgccggtacgtccgggagcgaggaggctacacaaagcacaacgagcggcacctcatccggcacacagcaaaaaacagacgtgctgcctgccggtgtcaaaaaactgtcgtatactttaaaagtggagtcagacagctacaagagcatgaaaacatttttacagacgattgaaaacttgccgcgcattacagtgatcgaaagcctcaatttcagtccgggggaaggagcgcctggatcgagtggattgcagtacaccgtcacggtttccactttttattacccggcgttaagccggtattcggactatttgccggaaatcgacgtgccggcagcgggacataaaagtgacccggtcgcaataaaggagcaataagttttcggcatgttcatccttgccattacatatgcttaatatcgcccgttgcttgccggtagcgaaccaagaaaataccttatgctgaaagatcagagggatcaaacatgcatggattgtggactgcttattttgcggcactgggaatggtgttcggctcgttttataatgtcatcgggctacgcgtgccgaatcatgaatcgattatccgtcccgggtcgcattgcccgaagtgtgggcactcgttaagctggtatgaaaatataccggtgttgtcttttcttgctttacggggcagatgcagaagctgccgcgcgccgatctccccggtctatccggtatttgaggcgctgaccgggggcttgtttgcctattctttttaccggttcgggtggagtcccgaatttttgcttgccgttttgtttatttcactgcttgtcatcattaccgtttccgatttggcgtatatgctcattcccgataaagtgctgtttccttttgcagccgccattgccgccgtccggctttttcatccggcgtcaccgtggtggtccgcctggctcggggcggttttcggcttttgcctcctctacctcattgcctttttcacaaaaggcgcgatgggtggcggggacattaaattgttttttgtcatcgggcttgtgctcggcatagagaaaacctttctggccttttttctagcctgcttttttggcgcgctttacggcgttggtttgatggctgccggcaaatttaaaaaacgaaaaccggtgccgttcgggccgtttatcgccatcggtgcgcttgccgcctattttttcggaaacagccttatcgggatgtatttgcgcatctccgggctcggataaaatttgcataaaatgccggaaatcggcgaatggttttcggacaagacgacaaaagtcttgttcttttttttgccggttatggtagcatgaagcaaatcgggcaggagaggtgaaaacattggacaaggcgaaaaaaaaggcgaaaattacagtcaaagtgggcggaaaaaaggtgcagccggaagaaagcgtgaaagtccatgactggaaagcggccgaagaaacggctgccgcacaggaagacagtgtaaaagaagaggagtcatttgaatgggtgctgcccgaacttgatgcggatcagattgaagaattccggccgatccattacacacccgcgcccaaaaagaaaagcatattcccgaaaaaagcggttgcgaaaagggctgcgccggcgattttgttttctgtcgtgtccgcgttggtgttcggggcgctgctcgggtttgttgtattaaaattcattgcgtacggcgatcatcaaacaaaactcccgaaacagcaggctgaaggcgctgcagcgggcacagcgcagcaagaggcccagcttccggcgttaagcatcggcatcatccaggcaggggtgttcagcacggaaggcgccgcctctaaagtgtcacgcgaacttgccgcgaaaaaggttccgtcgatgcagctttcgatggacgggcaacgctatatttttgcaggtgtggccgacagcctcggcacagccaaaaaaatggaaactgcctggaaagataaaggcgtcgaactgtatgcaaaagaaatcagtttttccagcaaaaaggtccaaacgacgacaaaggatgagcaaatttttgcccgggaaacggttccgctttttcaaaaactggcaaaagaaacggccgccgctgtccagaacgggcgggtttcaccggacggcatgaagacagccgaaacagcagccggcaacgtcaaaaagctggcaaaagtcaggcaggaaacgctcggccggttgaaaaaatacgaaacggccgcgtatgaatcgctcgttgcttatcaaaaaagcggcaaccggcaggatttaacggatgccgaacaaaacctgctggactacgtaaaggtctacagcgggcattgaaatcaaatgcgggcttccggctgaaaggctgtggtgccagataaaggcatgcgcccgcatagcattattttttgtctgaaaaggttgaatttgcagttgtttcacggcccgttttttggtacgatacaattgtatctcccataccaaagcccattggttcgattcccccgcctcctgcaccagaaaaggaggaattcatttggaaaaaatgctgatcaaagattttcctgcagaagaccgcccgcgtgaacggttgatccgcacaggagcggagagcctctccaatcaggaactgcttgccattttactccgtaccggcacgaaagaagaatcggtgctcgagcttgccaacagactgatccgccattttgaaggcttgcggtttttaaaagatgcttcccttgaggaaatgacgtccatcaaaggcatcggcacagcaaaagcggtccagattctggccgcgagcgaactcggcagaaggattgccaatttgcagcacgatacacgttatgtaatccgcacgccgcaagacggggccaattatgtcatgaatgatatgcgctttttatcccaggagcattttgtctgcctgtatttaaatattaaaaaccaggtgatccaccggcagacgattttcatcggaagcttaaatgcctcgatcgtccatccccgcgaagtgttcaaagaagcgctcaggcgttcagctgcttccattatttgtttccataaccatccatccggagacccttctccttccaaagaagatattgaagttaccaaacggcttgccgaatgtggtaaaataatggggattgagattcttgaccatttgatcatcggtgagaaaaaatttgtaagtctgagacaaaaagggtatttgtaaggctttgaatttttttatggttacgatataataaatcgtatgatttttacggccggcactgcgccggaaatacctgaattccggatgtagatttaaagtgacatccataaataagcaaaagtatggcaccaactggtgatgaaaatttatcgtgtagaaagggagatacatccatgttcggaagtaaagacctggggattgatcttgggacagccaatacattggtttttataaaagggaaaggaattgtggtgcgggaaccttccgttgtggccatccagacggatacgaaacagattgtcgcagtcggggatgccgcaaaaaaaatgatcggcaggacgccgggaaacattgtggcgacgcggccgatgaaagacggcgtgattgcggattatgaaacgacggcggcgatgatgaaatattatattcagcaggccacaaataaaaaaggctttttttcaaaaaatccgtatgtcatggtctgcgtcccttccggcattacggcggtggaagagcgcgcggtgattgatgcaacccgccaggccggggcacgggatgcttttacgattgaagagccttttgcggctgcgatcggtgccgggctgcctgtctgggagccgaccggaagcatggttgttgatatcggcggcggcacaacggaagtggcgattatttcgctgggcggaattgtgacaagccagtcgatccgggtggccggggatgaaatggacgaagcgatcatcagttatatccgcaaaaattataatcttttaataggggaccgaaccgcagaacaaattaaaatggaaattggttcagcaggtgagccggaggggatcgaaccgatggatatcaggggccgggatttgctgaccggtttgccgaagacgatcacgattaccgcggatgaggtggccgatgcgctccacgatacggtgtatgccattgtcgatgcggtcaaatacacgcttgagcagacaccgcctgaactggcagctgatattatggatcgcggcatcgtcctgacaggtgggggcgccctgttgcgcaacctcgaccatgtcatcagcaaagaaaccgaaatgccggtgctgattgctgaaaacccgctcgactgcgtagcaatcggaacaggcagcgcgctcgaaaatatcgaactgtttaaaaacaaagcaaaaaattctaaataggacatgctagtgtcctgttaacgcattctcctgccggttttttctggcgggagaatggttttcaatccgggaatggccggaacaaagtgttataggagtggattttatgccacagttttttttgaataaacgattgatcgtccttttaatcagtgtcattctgcttgtcgccatgatcggattttccattagggaacgcgaccggatttcaaaaccggaacagtttgtgcgcgatatcgtcgggctcggccagtccgtcattgccaaacccgccaatgcccttgccggtttttttgacaatatcgaggacttaaaaaatacatatactgaaaacaaaaaactgaaatcccatttggaacagctgacaagcctggaagcgcaaaatcatgaactgaaaaaagaaaatgaaaatttgagatctattataaaggaaaaaaacagtcttggagattcagagtccattcaggcccaggtcattgcacgcaacccggataattggtacgagcaagtggtgatagataagggcgaagtcaacggcgttaccaaaaacatggctgtcgtcacttcaggtggtttcctcggaaaagtgacgcaggtcgacaaattttattcaaccgtcgaacttttgagctcgcccgatgaaacgaaccgcgtatccgccaaagtgcaaaatgccaaaaaagacgcttacggtttaatcgaaggatacgacaaaaaagcaaaaatgctgcttttgaaacagcttgattttaatatcaaagtcaaaaaaggcgatcatgtcgtgacatccggtttaagcggcatgtttccgagcgggcttctgattggtgacattgaaaaagtaaccccggatgaaaacgggctgacgcaaaccgcttatgtgaagccggcagccaatttttatgatgtccgcgaagtgctcatcatcaaccggaaagcagtgaacctaggcagcgcaggaggagagcagtgatgaaacggatcgtgctccctctgattttaagcctgtgctatattgctgaaagtttatttgcccaattttttgccgcccgttcttttggcggaaaatttaccattgttccccattttctgctcgttatgctgattttaatggggatgcattaccgaaaaaggctctccatcatttatgcctttgtattcggcatgctgtttgatgctttttacacgggcattctgggcgtttatctgtttttctatccgcttgcggtttacctgacagaaaaaatggacaggatcctccagtccaatattttcaccggcacgcttgtggcagtcttgaacatggcgattgtcgaatttttggtctatggcatcaatgctttaattaatccgcaggtgatgggatttgacgattttctcttgctcaggctttggccgactttgattttaaatgccgctttttttattttggcatggtatccgatggggaattttttaaagcggcgtgcaagggaagaagaaaaggaataaccggcggggagaaaatctgttaaaatgggaaagaaggattttccgcctttttgtcgaatgatccggacaagggggaatggaaaaagcaaaagggtttgcgggccgaaaccagccggaaccgcacgcacggaggcttattcctgcgtgccgggccgcaaaacgccgtctgaaagccatttcggatgtgtcgttatttattgagccgttgaggtgagcagtttgaaatgaagaaaacgcaaaatgtaaccataaaaggcacgaaagacggaattgtgctgcatttaaacgaccaatgctcctatcaagctttaaaggcggaattagaacaaaaattactggcccagtctgtcgatgaggaggaaaacagcccgatccttgccgtcaaaattcagcttggcaaccgctatttgacgccagcgcaggaagaagagatcaaaagccttgtgcgtgcccggcggaaccttgttgtcgataaaatcatcagcaatgtcattacaaaagaagcggctgcgcgcgaaaaagtggaaaatgaaattgtgcctgttaccaccatcgtccggtccggtcaggtgttaaaggcggaaggcgatcttttgcttgtcggcaatgtcaatccgggcggaaccgtgattgcaaacggcaatatttttatcatgggaaacctccgcggcattgcgcacgccggttacagcgggagaagggacgccgttgttgtcgcttccaatatggttccgtcccaaatccggattgccgattgtctgaaccgggcgcctgatgattacgggaaagaagaccggcatgagatggaatgtgcttacatagatgaatcggaccatattatcattgataaattgcaagtgttgaaaactttgcggccgaatatgacaagattaaaaggagggttctcatatgggtgaagcgattgtcattacatccggaaaaggcggcgtcggcaaaacgacgacatcggcaaacctcgggactgcgctcgcgcttctcggaaagaaagtctgtcttgtcgatacagacatcgggctccgcaatcttgacgtcctgttggggcttgaaaaccggattatctacgatctagtcgatgtcgtagaaggccgctgtaaaatccaccaggcaatcgtaaaggacaagcgtttcgatgacaagctctttttgctgtcggctgcccagacaagcgacaaatccgccgtcacgccggaacagatgaaacaattgatccacgggttaaaacaggattacgattatattctgattgactgcccggccggcattgaacagggatataaaaatgcagtggcgggcgctgaccaggcgattgttgtgacaacaccggaaatctcggcggtaagggatgccgaccggatcatcgggcttttggaaaaggaagaacatatcgagccgccgaaactgatcatcaaccggatccggagccatatgatgaaaagcggggacatgctggacatcgatgaagtgacaagccatttatcaatcgatttgatcgggattgtagccgatgatgaagaagtgatccgcgcttcgaaccagggtgaaccgattgcgctccatccgacgaaccgcgcctcccttgcctaccggaatattgcccgccggattttgggggaaacggtgcctttaatgccgcttgaagaccagaaacccggcatgtttgcgcgctttaaaaaattattcaattcgaaatcttcttaatagcagagccgtttctgaacgtttttccaaacgatcagggcggcttgttttgttcccggttctaaccgctttggacaggtcatacattggtaataaacgaatgcctgtacagaaggggtgaatcgattgggaaaccgcgccgatgaaatccggagacaaatggcgaagcggagaaaaacgatcaagcaggcttataacggcaaagaaacggtctatgcgagcctgatcaaagatgagggcacacatgtatatgaaccgccgggcaaaacgccgcatccgctttttaaaaaagaaacgatgctgtttaaaattctggcttctgcctgtcttgtcctcgttgtggcgattctgtttaaatcggaacgtccggaatttgacaaaccgaaagccgccgtcaaacaggtaatggcgtccgaatttcaatttgcaaaagcagccgcctggtatgaaaaaaagtttggcaagccggttgcgctcttcccggaaaaatcgtcaaaaacggaaaccgctgcttccaatgaagattcgcaatatgccatgccggtatcgggaaaaattctgacccgtttttctgctgatggaagaggggttacgattgaaacaaagccgggcgcaagcgtgaaagcgatgagcggcgggacggtcatttttgccgggaaaaagccaaaactcggcaataccgttattatccagcatgccgattcaacggaaacatggtacgcaaacctcagcaaaatcgatgtgggccagtatgacagcctcaagatgggcgaaaaggtcggcacggcgcgaagcagcggggaaaaaggggaattttattttgcgcttaaaaaagacggcggttttatcgatccgatccaggtgattaaatttgagtgagcggttttggcttctgaaaaaaatcaaaatccatccccttttctggctcgtggctgccattgctgctgttaccgcccgtttccaagatctcatcctgctgtttgcgatcattttcattcacgaaatggggcacgcggttgcggcgcaatatttttcatggcgggttaaaaaaatcgccattttgccgtttggcggcgtcgctgaaacagaggaacacggaaaccgcccgctgaaagaagaactgatcgtgacactctcaggccccctccagcatgtttggatcgccgttttcgcgtatttgttgttccgcttcgatgtcttgcctggacagatgtatacgcaaatcggggagtggaaccgggccattcttttttttaatttgctcccgatttggccgcttgacggcgggaaattgctgaatatggcgttttccacggtttatccttttttgcgcgcattccggatgacgatttgctgttcgtttatcgtgctgctcctttttcatgcggccgccctgctgaatgcgccggcaaatttgaacgtctgggcgatcgccgtttatttatatgccgccctttggaaagaatggaaacagctttactttgtttttatccgtttcctgcttgaacggtattatggaaaaagggatccgctccgtcatctggaaacgatcgaggtggatgcgggcgcatacttgtatgaagtgctcgaaagctttaaacggggacgcaaacatccgctcattgtccttaaaaacggggtggaagtcgggaagcttgatgaaaatgaactccttcatgcctttttttccgagaagcaaaccaatgcgaaagtaagcgatatcctgtatagttattgatggaagccgcaatagaagcggctgaaagcgaagacagtgtggtggaattttttggacagatcaatcatcatcaacgtgaaaacaagggaaaaacgatatgcggtcatcgaaaacggcaaagtatctgccatccgcatccggcagccgggcgatgcggcaaaagtcgggaatatttatctcggcaaggtggcagacgtcaaacccggaatcaatgccgcgtttattgatatcggcggcatccggcacggttacttgcatatcagccggctccctgcttttgtgaacagcaaaaattcgaatccaacgatttcagcttatctttcgcccgggcagacggttatggtccaggtgaaaaaagatgaaacagggcaaaaaggtccgcttttaaccggcatcattgagctttcgggggaacagattgtgtatctgccggaaggaaagtacacggctgtttccaaaaaagcggatgatgcagaccggaacaagtggcggaacagggtccgcaaagcgcttgaaccgcaggaaggaatcattgtccggaccgcagccatccatgccggcggggacgggtggcgcgatgaactaaaatgcctcaggcttcggtacaaatgcctgctcgaaaaggcggcacaactgaaagcaccggctgttctgcacgaaaaaagcacggtggaagcggaaattttccgcgaacttgtccgcttaaaaagcggcacggtgatcgtggatgatgcggaggcacttgcccgcctgaaagcattgcttgcgggccggccggaactggactggtcgtttgagctctacagcggaaaacagaatatttttacccgctaccgtatcgaccggacgcttgaggaagccttgaaaagagtggtctggcttgaaaacggcgcctatcttgtcatcgacgaaacagaagcgctcaccattatagatgtgaataccggaaaatatacgggtacaacggatcaggccgaaacggtgctgaaaacgaatctgcttgcggcgaaagaaatcggccgccagctgaaactgcgcgattacggcggcatcattcttgtcgattttatcgatatgcagtgcgatgaacagcgcgcacaagtgagggcggtgcttgaaaaagaactggaaaacgacgagaaacaaacccgcatcaccggttttacggagcttggcattttacaaatgacgcgcaagaaaacgcgtaaatcgctccccgaggcactgctttccgtttgcccggtctgcgggggcagcggcaaaatcgaaagccccgagacgcttgctttccgcctcgaacgcgagctgtgggaagcgccgtacgcggattacgaagccgtcttgattgaatgcacgcaagatgtgaaggactgtttttgcggggaaacggacgtacatttaaagcggctggaaaacctgctcggcatgaaactcatttttcacatcactcgcgatccgcatccgttttatgccatccggcagttcgggacggcagccggccttgccgcaaaaggcaaagatcccaattgacaaaggaaaaagtgtgtgttaccatcagtatgttatgtttgtagcgccctgtgctacaaccgctcaggaacaggctttgcaagtttttacatttcgtaaaacgcctgtctttggcgagtctgagtcttaaggaggtgcagtgatgtacgcaattattgaaaccggcgggaaacaaatcaaagtagaagaaggccaagctgtatatattgaaaaattggatgcagcagaaggcgaatcggttacatttgaccgcgttctttttgtcggcggcgaatcggtaaaagtcggtagccctgttgttgaaggcgctacggttacgggtaaagtggaaaaacacggccgtgcgaaaaaaatcgttgtattcaaatataaagcgaagaaaaattaccacaaaaaacaaggccaccgtcagccgtacacaaaagtggtcattgaaaaaatcaatgcgtaaggtgcacgcggcatgatccgggtccgcatcaaacgcaaaaagaatgggaacatctcatcttttcaaatgagtggccatgctgaatttgccgaatacggccaggacattgtctgtgccggcgcttccgctgtttctttcgggacggtgaacgccattatgcaagtggcgggggttgaacccgaaatccgccagtccgaaagaggccttttggaatgcaaaatcccttcgcatctttcggaagaacaggcgacaaaagtgcagattctgcttgaaggcatggttgtatccctcgagacgatagaacgggaatacggcgaatttatccatataacctttgaataggaggtgagcatcatgttgaaattagatcttcagtttttcgcttccaaaaaaggggtcggctccacgaaaaacggtcgtgactcgattgcaaaacgcctcggcgcaaaacgtgcggacggccagttcgtaacaggcggctcgatcctttaccgccagcgcgggacgaaagtttttccgggcgaaaacgtcggccgcgggggcgacgacactttgtttgcgaaagttgacggcgttgtgcgttttgaacgactcggccgcgacaagaaaaaagtgagcgtatatccggtggcacaagaagcctaacccataaagccccgggctgcgatattcgcggcccggggcttttgcattttccaataaaccactcccgttctgaaaaacgtacaaaaaacgggttgtcgcgttcttctggcgagtgccgggcacatgccgctatcattcgcgtcccgtgcaacatgaggcaatttttgctatacttaaacataacctatttcggagaacgggagctatgaaaatgcgggaatggacgacggttgacgtgcttcgccacgccaggcatgactggctgaacaaggtgcagctgatcaaaggatacgccagcttgaacaaaatggaaaaggtcaaaaatattgtggaagacattatccgggaagcgcagcaggagtcaaaattatcaaatttgcatctgccggaatttgccgagcttttgcttacatataactgggaagggcacacggtgcggattgcatacgaaatattggatgtggaccggaatgtgctaccggacgatagggagctgaccggctggatgaagaattttttcgctatcgttgaagaagcagtcgatccaaacggagacaaccggttatctttgtcggtcagcactttgccatccggcgcccgtttctttttcgagtttagcggtacaataaaaaagtacggactgcttgccgggtttctggaaaacgattgtccggggatgaacgtgatccacgcgtacccgcaatccgctttcccggttgaaataatctttctgaaagcctaacgatacagcaattgcaaaggtggttttatcttttatgtttgtggaccaggtgaaaatttatgtgaaaggcggggacggcggcaacgggatggtcgcattccgccgcgagaaatatgtgccgatgggcggccctgccggcggggatggcggccgcggcggcgatgtcatttttgaagtcgatgaagggttgcggacgctcatggatttccgctacaagcgccattttaaagcggaccatggcgaaaacggcatgagcaaaggaaaacacggccgcggggcgaaagacatgattgtcaaggtgccgccgggaacggtcgtcattgatgatgatacaaaacaaacgattgccgatttaacgcgccacggggaacgggcagtgattgccaaaggcgggcgcggcggcaggggcaatatccgctttgcgacaccggccaatcccgctccggaaattgccgaaaacggcgaaccgggccaggaacgttatattgttcttgaattaaaactgcttgctgatgtcggccttgttggttttccgagcgtcgggaaatcaaccttgctttccgttatctcttcggcacgcccgaaaattgcggaataccattttacgacgcttgtgccgaatctcggtgtagtcgaaacggaggacggcagaagttttgtcatggccgatctgccggggctgatcgaaggcgcgcacgaaggcgtcgggctcggccaccagtttttgcgccatatcgaacggacgcggttgatcgtccacgtcattgacatggcggcggtggaagggcgcgacccgtatgaagattatttgacgatcaacaaagaactgaaagcttatcatgaacgcctttctgagcgcccgcagctcattattgccaataaaatggaccttccgggcgcggaagaaaatctggcggcgtttaaagagaagctgggcgatgtcgcacgcgtcttcccgatttccgcggtgacgcgcaaaggattaagggatgttttgtttgcgattgccgatctgctcgatgaaacacctgccttcccgcttcatgctggcgaagaaccggatgcggaaccgtcccgtgtattgtacaagcatgaaaaagaaaaggccgattttaccattacacgcgatccggacggcagcttcgtcatccacggggaaaaagtcgagaagctgtttaaaatgacaaatttcagccatgacgagtctgtccggagatttgcccgccagctgcgcggaatgggcattgatgacgcgctccgtgcacgcggcgcgaaaaacggcgataccgtccgccttttggattttgagtttgaatttgtagattaaccgtgctgggccggggaatcccggctcccgagtggaggaaagggcactttggaaaagaaagcagagcataagtttatcttggtgcgtgaggatgttttgccggaagcgatgatcaaaacacttcaggcgaaagaactgctggaaaggggacaagcggtatcggtcggggacgcggcgaaaaaagcgggcttaagccgcagcgctttttataaataccgcgataccgtttttccgttccattcggttgtaaaagaaaaaattgtgaccttgtttttttatttggaagaccggtccgggacattatccgaaattttaaggattattgcatcttactcatgcaatattttaacgattcaccagacgattccgatacaggggcgggcaaatgtcactgtttcgctgaatgtgtccgggatcaacaggagtttaaatgatctgctggaagaactgcaggcatttgagtttgtcaataaagtagaaatattagggtccggagcctagaactccggccggcgggggagaggaaatgaaagcagcttttttcgggccggaagcgacgtttaccgatatcgcggtccagtcagtgttcccggaggccagccgggttgcgtatcggacgattccggaatgtctagaagccgtgaagacaaaacaggtggatatggcggttgttccgcttgaaaacgccctggaaggttcggtaaatttaacggtcgattacttgtatcatgaagaactgccgccgatacgcgcggaaatcattgtgccgatcgagcagcattttatggttcatcctgcaaatgccggcgcctggcgggaaacggaaaaaatcatttcccattcccatgcgcttgcgcagtgccaccagtttctgcgccgggaattccggcatgcggaagtggaagcaatgggctctacggccgctgctgcgaaatatgtaagcgaacacccggaactgaaatggggggcgatcgccaacgaaatggcagcggaactgtacggtcttgaaattgtcaggcgtgcaatccatgattatccgtttaaccatacgagattcattgtcctttcaaatgaggagcttcatatcgaaaaaacgcctgatttcctgaaatcgacgatcatggtcacattgccgacggacaaggccggatcactgcaccaggtgttgtctgcctttgcctggcgaaagattaacttgagcaagcttgaatcgcggccgttaaagacggggcttggaaactacttttttatgattgacctgaaccactccttagaagaaaagctcgtccgcttttcgcttgaggaaatccacgcgctcggctgcaccgtgaaagaactcgggacctattataggtatatggcggataaatgatgatcgcttcttcaagaatgttaggataagcccggctggaacccgggcttattttttttttgcaaaacaagctttaaacccaggtttttaggccggatgggtgatgaaaaagagctgtcctttatgtttagggcagctctttttcattttctgcaaataaaatgccagcttctttcagcgcctgttccgcttcttcaacctgccgcccgcttgcggcttccaccgtatgcaagtggatgccgcctgttaattcggataagtagctggcatttgtttcttcaatttggcggataaaccgggccacttctgcgcgggtggagaccatgatcgaggcggtcagatcgccgtataccggatgctccaccttgacatcttttacggtcaccccgtggtccacgagcaaattcagctcatctgcgacctgttcgcgactatgcatacaaacaagcgttttctccactttgttttccgcaccggcggggtgtatgtacaaatatccctggctcgttgccaggatcggttcgtttttcgctttcaggagcgtaatatcatttactataatctgccggctcacatttgtcctttttgccagttccccgcccgtaatcggctcccggctattctgcagccattcgaggatcaaatgccgcctttcatccccaagaatttttttcttctctgccaacagcgtttccccccattcattcggcctcattcggattttatcatacgaaggcgccgggatgaaagaatcaaccctttaaagggcataaaggacgcgggacgttcataagtttttatgtaaaatcaatcgcattttgcccggcaccacatagaatgtatggacttaagccttgaggaggggaaatgtgtgaaaatccatatcgtgcaaaaaggcgatacgctctggaaaatcgccaaaaaatacggcgccgattttgacgaattgaaaaaattgaatgcgcaattatccaatccggaaatgattatgcccggcatgaaaattaaagttccgacaacgggcggcatggtaaaaaaagagacacatacaggccatgcaggttatacgggccacgcgggtgcaaaagaaatgccgctcgtgacccatccgtacgagcaaatgcctgaggccaagatgcccgtcgcaaaagaaatgccggtaccaaaagaggtgccaaaagcgccagcaccgaaagaaacacaggtgaaagaaaaagtggttgaaaaaaaagaaacgatttataagccggtgatgccgcaaccggtcattcctgaaattgacatccataattactatgtgaccaatatggctgaaatcgaaacccatacagctgcaccgccgccgaagcaccatgaaagcgaatcgtcggaaagcgtgcactacaccatgccggtaaaggaagagtgcccggaaatgtatgtaccgtataatccgtgtccgcccgtgatgccggtatacgattgcggctgcgggggaggggacatgcacgccggatttttcccgcctccttacagcatgccatatccgcaagtcccatatccgatgccgtacccaatggcctatccgcaaatgccggcgatggccgcgccaacagggttcacgcaaataccggcgatggccgcgccggcagggtttatgccgcagcagcagccggcatggcatgaggggcagcaagtgatgccaggttatgaatgggaagaagaatcctcttcgtcttctccttatccgtatggccccggtatgcaagcgggggtttctgcgcaacatcctgccgccgcgccgcaatggggagcgcagcaggctcctttatacggcgctgcttcagaaagctccgcctatatgccgcagtacatgccgccgcaaacgatgccgcagtacgccccgtatccgccgcaccagcagccatgcgggtgccaggagcaaccttacggcggcgtgcaggaaccgtacgggatggcgccgcaaccgtacggcatgcaggaaccatttggtggcatgccgcaaccgccatacgggatgtcgcaaccaccatacgacatgcaggaaccgtacgggatgcaggccccgttcggatatgaccggggcgaaaaaacggaccagccgcaggaaaaacgggatccttccggcgaagaagaaaaataatgggcggccggagacaagagggagacgaaaccaaacgtctccttctttatgcggaaaacagactgcaggaaccgattgttgactggcgcaggttgcgtgaccgggtatggcttatcggaacaaagacaaagaaagtgatcatgaagcaatatggttccgatacgcgccttaaacggcaaatgctgcttacatcggaactgcggaaaagcggtttcacccaaacttgccgttttctggaagatgacaacgacagcccctttcaaggcaaagcttttgggtttatggcatacattgaagaagacccggccggttttaccttcgggacggaagcagacatccacgccgctttccgcctgttaaaacagtatcacgaaaagaccgcgcactttccgcaagccgtaaaaatggaatttccgcgctttttccagctgagaaaatggcaggcgcggtaccggacatttctggaaaacaaagaacaaattgtccggtatttgccggaaacgtattttgccgcgtacgaaagatgggcagccgaggcgttaaaccggcttgagaaaaaacagcatttgcttcaccgtccgccgtattgcatcacgcacggtgatgttgcccaccataattttttgcgtgcgaaaaacggggaactgtatttgattgattttgaccttgcccgccttgccccggcctggaccgatgatctccagttttgcaaccgggttttgcccgctgcttcatggtcgcttgctgctcttgaaaagtggggaatgctggacggtgcgccggacagggaaacttttcttgaggcgctcctttacccgacggatgttttaagagagtggaaccggtttgttggaagcggcaaaaaagaaaaagagcagtactggccgcatctttccctgctttccatcgggcaattcggggaacgcgcccgctttcaaaaagaagtaaaaaggcgtttgcaagcataacggaaaaacctggacgcttacggccagcataatgcttttcatcctcctttcgggcgagtatggtatagtaataggggactgtatcagcgctgtcagaaaggagtgatggccatgtccggccattccaaatggaaaaatattcaaggcagaaaaaatgcgcaagatgcaaagcgcggaaaaatctttcaaaaactggcaaaggaaatttatgtagcggcgaaaaacgggcctgacccggaagcgaactcaagcctccgcctagtcattgaaaaggcaaaggccgccaatatgccgaatgacaatattaaacgcgccatcgagaaagcaagcggcagccaaaacgccgaacattacgaggaaatcacatatgaagggtacgggccgggcggcgttgccgtcatggtcaaggctttaaccgataataaaaaccggaccgcttccaatgtccgtgttgcgttttcgcgcaacggcggaaatctcggcgaaaacggatgcgtgtctttcctgtttgaccgcaaaggctatcttgtcattgagcgggaagggctcgagatagatgaagacggaatgctgcttgccgcgattgaagcaggcgccgaggaaatggaaacgagcgatgaagtgtttgaaatttatacagatccggagcaattcatggatgtgaagaagaacctcgaggaacaaggctttacgtttgcccgagcagaaattaccatggtgccgcaaaacacaattgctttggatgaagcgcaaaaagaaaagatggagcgattgctggacaggctggaagacgatgacgatgtccaggaagtttaccataacgccgaatgataatgtcccagtcactttccgcacccggtccggccgggtgcggaaagtgacttttttgcagcaaagccggttagccctgtatccaaccggttacactgtggagagggcccttgctgtttttaaaccggcgcactacgagagaggaccatgctgttttagaccggtgcactgcggaaaggggaccatgccgtttttaaaccggctgcactgtggctaaagaatcgtgccgttaaaacccggacgatggtttcggctggaaatccgggaaggtcgttaagaggcagcgagtattcgaaaaaaagtgagcccggtatgccacacggacacggatctgtctccggatgccggtttccttccgccatggaaacaggaaaagcgcctcagctttaggaaccatccggccggaaaaaaagggcaagaccggacattcgttcccaaaacggttgcgttctgtggtacaatatgggatagcaagtttttgaggagcgtgtgggaaggttgtacgaatatattaaaggcatcattgattccgtgagcccggattacgttgtcgtggaaaacggggggatcggctaccggctgctggcgccgaacccgtatattttttcaaaaagcatcgggcaggaacgaaaaatttttacataccagcatgtgcgcgaagatttgatcgcgctttacggttttgaaacggcggaagaacgggcgctgtttcaaaagctgcttaatgtttccggcatcgggccaaaaggggcgcttgccattctagcgtacgggcagccgcagcaggtcgttgacgccattgagaatgaaaatgaatctttccttgtcaaattccccggtgtcggcaaaaaaacggcaaggcagatgattcttgatctgaaaggaaagctgcaaggcctcgtaccggagatgccggacgaggcaggcggggaaaaagcggtgcctgcatccaccaaccaaaacctcgaagaagcggtgctcgctctggcggcgctcggctattcggaaaaagaaatcgcgaaagtggtgcctgaacttccggaagaagtgctttctgcggatgaatatattaaactcgctttaaaagcaatggtaaaataatggaggaggggagagcatggaagaccgcgtagtttccggcgaggcaaacgaacaggaagtttcctttgaaatgagcctcaggccgcaaacccttgcgcaatatatcggccaggatgaagtgaagcataatttagccgtgtttattgaagcggcaaaaggacggcgcgaaacactcgatcatgtgctgctttacggtccgccggggcttggcaaaacgacgcttgccgccgtgatcgcaaacgaaatgggcgcgaacatccggacgacttcagggcctgccatcgagcggccgggcgatcttgccagcgtgttaaccgcgcttgaaccgggggaagtgctgtttattgacgaaatccaccgcctgccgaaagcgattgaagaagtgctgtacccggcaatggaagacttttgccttgatatcgtaatcggcaaaggatcgggtgcccgctccatccgccttgatttgcccccgtttactttgatcggggcgacgacaagggctggttcggtttcagcaccgctgcgcgaccggttcggggtgatcagccggctcgaatattataacgaagcgcaactggcggaaattgtgctgcggacagccggcatccttgagacggcgattgagcctgagggggcggcggaaattgcaaggcgttcgcggggcacgccgcggattgcgaaccggttgttaagaagggtgcgcgactttgcccaggtcaaaggagacggaaaggtaacccttgagatcgccaattatgcccttgaacttttgcaagttgacaaacgcgggcttgaccatattgatcataaactgttaaaagcgatcatagagcgcttccggggcggtcctgtcgggctcgacacgattgcggccagcatcggggaagaaagggaaacgattgaagatgtatatgagccgtatttgctgcaaattggctttttgcagcgaacgccgcgcggcagggtagcgaccccgctttgctatgcgcattttcatatggaggtgccggaatgagcggatttggaaaagtgctgatgacgatcgccgtgattctttttgctctcggcctgttgttgcagtttacgaaaatcggccggctgcccggcgatatcctcattaaaaaagggaacacaaccttttattttccaatcgcaacatcgatccttttaagcgtgatcttaagtgtgttattatatatcattggacggttcaagtagccgcaaatggaattcaaaacgaaggggaagcaacaatgaaactcgatttatttgattatgacctgccggaagagctgattgcccaaacgcctttaaaaaaccgttcggacagccggctgatggtgctggataaaaaaacaggggaaattgaacacagcgtatttaaaaacattacgcaatacctgcgcccgggggactgccttgtcctgaacaatacaaaagtattgccggcaaggctgatcggcataaaagacgaaacaggcgcaaaaattgaggtgctgcttttaaaacagctcgaaggagaccggtgggaaacccttgtcaaaccggcaaaacgtgtgaaaacagggacggttgtccggtttggcgacggaaagctttccgccgtttgtgcggaggagctggaccatggcggccgggtaatgaaattccggtacgaagggattttttacgaagtgctgaatgaactcggaaaaatgccgctgccgccctatattaaagaacagctcgaggaccaggaccgctaccagaccgtgtatgcaaaagaaccgggttctgccgctgcgccgacggccgggctccatttcacggaagcgttattgaaaaaaattgaagcaatgggcgtgaaaatagtctatattacgctccatgtcggccttggcaccttccgtcccgtcaatgaggaaaatattgaaaaccatgatatgcatgcggaattttaccaggtatcagaagaagcggcccgcacgattatggaagtaaaagaaaacggcggccgtgtggtctctgtcggcaccacctccacccgcacacttgaaacggtggcaagcgcccatggtggaaaaattgccgcctcaagcggatggacggatatttttatttatccgggttatcaatataaagcaattgatgccctgatcaccaatttccacctgccgaagtcgacgcttattatgatggtaagcgcattggcagggagggaaaatattttgcatgcctacgagacggcggtaaaagaaaaataccgtttcttcagtttcggggatgcgatgctgattaaatagtggaaggagcgcatcacttggctgccattacttatgaactgatcaaaacggaaaaacatacaggcgcccgcctcggaaaactccatacgccgcatggcacctatgataccccgatgttcatgccggtcggaacgctcgccacggtgaagacgatgtcgccggaagaattgaaaacaatgggggccggcaccattttgagcaatacatatcatttgtggctgcgccccgggcatgatattgttaaagaggcaggcgggctgcacaaatttatgaactgggaccaggcgatcctgaccgattcaggcgggttccaggtcttcagcttgagcaagatccgggacattacggaagaaggcgtccatttccggaaccatttaaacggggacaagctgtttttgtctccggaaaaatcaatggaaatccagaatgcgctcggttccgatatcatgatggcattcgatgagtgcccgccgtaccctgcttcttatgaatatatgaaacagtcggtggaaaggacagcgcgctgggcggaacgctgtctccgtgcgcatgcgcgccccggtgtgcagggcttgttcgggatcgtacagggtggcgcgtatgaagatttgcggcttgaaagcgcaaatgcccttgtgtcgctcggcttcccgggctatgcgatcggcggcctgtccgtcggcgagccgaaggacgtgatgaaccggatgctcgcatttacaacactgctgcttccgtcggacaagccgcgttacttgatgggggtcggttcgcccgattctttgattgacggcgccatccgcggcattgacatgtttgactgcgtgctgccaacccggattgcaagaaacggcacggtgatgacatcagccggccggctcgttgtcaaaaacgcgcagtacgcccgcgatttccgcccgctagatgagcattgcaactgttatacatgtcggcactattcacgcgcttacatccggcatttgattaaatgtggcgaaactttcggaattcgtctgaccacttaccataatttatattttttgttaaaattaatggaaaatgtaaggcaggcgatccgcgaagaccggctgcttgatttcagggaagaattttttgagcaatacggatttaaccgtccggatgcaaaaaatttctaatacaagcaactaaagaagggaggattcagatggcgtgggctcagttactgcctttggtgattctgtttgtcctgttttatttcctgctcatcaggccacagcaaaagaggcagaaaaacatccagcagatgcagagcaatctggcgaaaggggacaaaattgtcaccatcggcggcttgcatgcaaccgtggattcgattgatgaaaataaagtcgtcttaagatgcgacaacggcacgcggctgacgtttgaccgctcggcgatccgtgaagtaacggaatccgttgcagcgaaaaaagcaaaagtcgaaagccagaaagcagacaaaacagtggcagaaaaaaatgccggagaaacgaaataaaaaaagcgccgtgtaatgcggcgcttttttttcaggattcccgtgaccttcctgagaagaggttgacccctaaaatgccccccattgcggcggcaacaatatagcaagcatggtaaatggcttgtttcaccgtaaagagttcatcataaccaaggtactggacgagaaaaacaatcgctgtgtagaggatccccgtcaaactgccgaggagccaccctttcttttttccttttccgccgccgacgagccccccgagaaataaactgaaaaaagaaatcatcgtgaccgccgtatgcaaagcatgctccgtcatatccgaaaaccgcagaatcagtgaaatcacgaggcttgatatggcaagcaggacaaaaatgacgcccagcccgtaaacaaggccgatactgtatttttgcgctccgattttcattctccccctttgacaagctttttcctcagtacaagcatatgcctggaaacagcaaaaagaaccgggcaaaagatttttgagagttttttaagcatgctgcgcatactaaatacatgattttgaccgaacggggggattggcgttggaaaatttattgattattttttttcggacacttctgatgtattttgccattcttattattttccggttgatgggaaaaagggagatcggcgaactgagcgttttggatcttgttgtgtttatcatgatcggggagatggcggtcgttgccattgaaaaccacagtgagcccgttgtaaatacccttttgccgatggttgtcctgctcggcatccaaatcgcgctggcgcttttctcgctccgcagcaaccggatccgcaagctgattgacggcaagccgagcattctcatcagtaaaggaaaaatcgatgaaaaagaaatgcgcaagcagcgttacaattttgacgaccttttgatgcagctccgttcaaaagatattgacaatattgcggatgtggaatttgcgattctggaaacttccgggcagctgtcagtggtgaaaaaaagcaaaaacaaaaacaaaccggcatcctatacggaaccgctcattgtcggagggaaaatccagcaaaacaatttaaagaaaagcaacaagaccgaagcatggctgcgcagcgagctgcaaaaaagagggtacggggatatcagccggatttcgttttgcagttatcaggatggcgagttttatattgatctggatgatgtgcaataagcccggccggaacatgcagggcctattgctctttttatagccatttattcaggatcggaacatacatgagatcggaccggcggatcaattttgtcatcacaagcagcagagcataaacagccacggtcaaacaaatgcccactaaaagccgcaggaaagatgcgtcttgcgccattataccggtgaaccaccagtgcccgaatgcgccggaaacgaccgaaacagccagaagcttggcccagtcatggacatacagggtaaactggatttttttcaaaacggttgcaaaatgaagaaatgtcacaagcaccattcccgccatgatgccgatcgcggcgccgttgatcccgaactccgggcgggaagcaaggacaaaaatggtgcccagtttcacgacggctccgatgatgctgttgatcatcgccgcttttgccagatccattgcctgcagtgcggcctggagcggcgcctggcatgcctggaaaataaaaaatggcgccatgattttgataaactgtgacccgtttgccgtcccgtacatcgcctgcatgagcggttctgcaaagacatacaggatgacaaccgaaatgccgccggttaaaagggaaaaacgcaatgcctgctggagcctgtgttcaacaagtctggcatttttccgggaatttgcttcgctgattgcgggcacaagggcggttgacaaggaaaccgtgacaaaagacgggagcatcaacagcggcatcgcaaagccggttaaagaaccgtactgttttgtcgcaagatgtgaagcgacaccggcaagagcaaggcagtgggagacgacaatcggctcgaggaaccaggagagattgccgatcagccggctccagacggtcggaaccgccacgcgcatcagttcgtaaaacgtatctttccccgattttacggctttgaaaaaatgtttgcggacgcgaatctgctttttcagtttaaacatcgtaaacatataaagaagggatgacagttctcccaatatcgatgcaaacatcacccctgctgccgcatattcaatcccgtacggcagaagcaaattggcaaaaaatgcgatcagcataatccgcacactttgctcgatgacctgcgagacggcataaggcttcatgttttgcttcccctggaaatagccgcgcaatacagcggaaaccgccacaatcgggataatcggcgtgatggcggcaagcgggtaatagacgcgcggatctgtgaataaatgatcagccagatacggcgcgagtaaaatcagcccgggcgtaaaaacggccgacagcgaaatggtaaccgttagggagatgacaagaatttttttaattttcgccctgtccccgaccgcgtctgcttcggcaatgcatttcgagatcgcgaccggcagcccgagctgggttaccgtaatgacgagcattaaggtcggaaaagccatctgatggagcccgacacccgtttccccgagcgaccgggcaatgacaatccggttgataaaaccaagcacccttgttacaaagcctgcggcgagcaatataatcgttccccttaaaaacttggacattctgttaacctgccttctcaaatccgcaattttcctatacaatgatgtatatgcacggtaatggacaagaatacatcaatgcctaaggaaaggggcagagcgtgtgaaggaccgccatccttatgaaaaatactataaaaaacttgaacctgccgtaaaaagcaaggcggaagaactggccgtctttggctacggcgcgattgaagcgagggatgtctgggaatatttaatccggaaagtgtggaaaaatccggatccggcgcatgtccgtatgtatgcgcttgtttccgacgttttatcggttaagcccggcgatttgatgagttttaaaaccgtggaagcttaccgttcgccaaactggtttgccgagctggacgaaaaggagctggatgcgctttttaacggggacaagacggaagaataagcgggcaaataagcaaaaccggctgcatgcggaataataagaaaaattgacacgctttttgccctgcatcataatagaaatgattcacgggcgcatgcattttttggcatgtgatatgttttgattcgctaggaggctgtacataatggtgaaaaggagccgcatcgttgccttctttctcattgtcctgctgtttgcaggattaatagggggaacgacggataaaattgtcaaaaaaattaaccttggccttgatttacggggcgggtttgaagtgctttacaaagtggaaccggccaaaaaagggcagaagattgataaagccgcgcttgcggatacggctgccgcattggaccggcggatcaatgcgcttggcgtcagcgaaccacagatctcggtcgaaggcaataaccggatccgcgtccagcttgccggcgtgaaagaccagaacgaagcgagaaagatgctttcgacaactgctaatctgacattccgtgacgtcaatgacaaagtgatgatggacgggacagaccttgtgcagggaaaagcgaaacagtcatttgaccagaacggcaaaccggatgttgtcctgcagttaaagagccggaaaaagtttgccgacgtcacgaaaaaaattctggcgatggcaccgaataaccagcttgtcatctggatggactttcaaaagggcgattcctataaaaaagaagtggcgaagaagaatccaaaatttttgtccaatccgagtgtgaattctgttttaaacacagatcaggttgaaattaccggaaactttacggtaaaagaagcgtccaatcttgcagacctcttgaatgcaggagcgcttccggtgaagctgcacgaaatctattcgacctctgtcggcgcatctttcgggcaggaagcgctgcatgacacgattcttgccgggataatcggcgttgcagccatttttctctttatgatcggctactaccgttttcctggttttatcgcatgtattacgctatctgtttatattttcctgattttgctcatttaccgtttaatgggcgcggtgctgacgctccccgggattgctgcgcttgtcctcggggtcgggatggcggtcgatgccaatattattacctacgagcggattaaagaggaactgcgcgtcggaaaaagcgtgaaatccgcgttccgggcagggaacaagtcatcgttcgtggccatttttgattccaacttaacgacgattcttgcggcggtcatcctcttttatttcgggacaagctcgatcagaggctttgcaacaactttgattattagtattctgctcagcttcctgaccgcggttttcggctcgagatggctgctcggcctctgggtgaacagcaatttcctgaaaaagcggccgcactggttcggtgtgaaaaaatcggcaatccacaatattgctgaaaacgttgatacgcatgatttgaaaacgaaatttgactggtacgactttgtcaagcaccgcaacattttctttatgatttcagctgtgctgatcattggcgggtttattctcctttctgttttcaaattgaatctgagcattgatttttcgagcgggacgcgcattgaagtcagttcaaatcatgcgctcagccagcaggagattcagcgcgaccttgaccatctgcatttgaaatcggaagatattgtgatgcaggggaccaaccggcatcatgccgtgatccgggtgaaaggctcgttcagcggtaaagagaagagcacgcaaatcaaccagtattttacagaaaaatacgggaagagcccgagcatcagctccgtttcgccgacagtcgggaaagagttggccttaagcgccgtttattctttgctgttggcggcagtcggcatcattatttacgtggccttccggtttgaatggagaatgggggttgcctccatcgtcgcactcttccatgacgcctttttcatgatcgcctttttcagcatcacaaggcttgaggtcgatgtcacattcattgcggcggtcctgacgattgtcggttattccatcaacgactcgattgtcacattcgaccggatccgcgacaatttaaaccggcggcggaaaattaaaaccgcgaaggaaatccatgatattgtcaatgccgggatccgccagacactggcccggtcggtcaataccgttttgaccgtgctgatgacgtccgtggccttggccattttcggcagcgaatcgatccgcaatttctctatcgcgctgattgtcgggttaattaccgggacatactcgtctgttttcattgccgcacaaatctggtttgtactgaaaaaacggcaactgaaaaaacatggcgccatcatcattcaaaaagcgcggcgtacccgcgcggatgaaccgcaagtataagaaaaatgcaggcgaaatgcctgcattcgtagacgggctcttcgttaagaaaggcctgcaattttcaccgctttcttcacatagacgccctctatgttaagaaacagcgatttttttcgcatttccttaacgtagatagcctctatgtacagaaaacaacgtcatttttccacgcttccttaacatagggcttgctgaaatatcagaatttctagctttggcaaggaagttataagtgtcttccgactattattcgtaccgtaaagcctgaatcggattcagttttgacgctttatttgccgggaaaacgccgaagacgacaccgacaatgagcgaaaagccgaacgaaagagcagtaaccggaagcgactgggtggcgcccgtgctagcaaaaagcgcgtaaattttgatagcggcaaacccgacccctacgccgagcagaccgcctaatgcactcaatacgaccgcttcgatcaaaacctggacaagaatatccttccgttttgccctgctctttacatagaaaagcgaccctcccccgatgaccacaacaatcaaaataactataatgatccacttcttcatctttatgttctcctttcctgttttccaatttttacaggaaccatctattctactttctgggcttcattatgatggggcaaacttaaatttttcttaatgttttcgtttcaaattgcgaggattgaaaaacaggccgcaccgtcagcccgatactgccggtatatgatgggaatcgacaaaaaggatattcaagcgtagcgaatcatgttataatatccaattatatgacgaaaaagtgagggccatcgatgaagaaaaaaatcctgatgtcttttttaagcttaattgggatcctggtcatcgcctgtggcggttatgcctattatgtttatcactcggcaaaagctgcggctaataaaatgcatgaatcgctggcaggcacttcaaatgaaagcatctcaagccagaacgggcagccgatttccgttttgctgcttggtgtggatgaacgtgcaaatgacagcggccgttccgatgccatcattgtgatgaccattaatccgaaaaaaggcacgacacagctggtcagcatcccgcgggatacaaggacgctgatcgccggacgcggcacatatgacaaaatcaatgctgcgtatgcatatggtggaaccgatatggctttaaagacagttgagaactttaccggtatccaaatggattattatgtaaaaatcaacatgcaggccctgaaaaaactggttaacgcggttggtggcattaccgtcaacaacacgattgactggcatgacgaagggtactataaaaaagggtaccattacaaaaaaggggaaattcatttgaacggagcccaggcactcggttatgtcagaatgcgccatcttgatccggaaggggatttcggccgcaataaacggcagcggaaagtgatcgaggcgctgattcagaaagcaaccagcatttcttcggtgacaaaatatagcagtattcttgatacgcttggcgacaatgtcaaaacaaatatgacgtttaatgacatgctgacgatagagaaaaactaccggaatgccgccaaaaaaattacccagtatgaagtaaaaggcacagacaccaactttgacgggatctattatttatcggtgtcagacattgaaaaagaaaaagtcacgcagatgctggaagaaaacctgtctggtgactaaggaatattggaaacaacaacccgcttcagcatgcagaagcgggttgttttgtcaacggctctcaataaaccggatcacctcttcaagcggcgtttccgccattgacccgaggcggtggtcaatctcgccgaacttgaggtcttttgttacccggtttgggacgaccacgcatgccataccggcgcgttttgccgcaagcgacccatttggcgaatcttcgaagacgaggcattgttccggttccacgccgagacagccagccgctttcaaatacaaagcagggtccggtttgactttttccacgtcatcggaagatttgatgcagtcaaaatacgcaagcaggccaagctggcgcaaatagcggtgcagccatttcctgtcagagcttgaagccagcccgactttaagcccgagctgcctggccgactttaaatagtcttccacgccttcgcgggccgcacctttttcgagccgttttaaaaacatttcctccagcttgtgatccagtttttctgtatcaagcggctttttgatctgctcttcaagatatttaaacggtttaaaaccagaatgcgtgccaatcccctttccccacagctcaagcggcatctcgcaatcgtagccgcgaaaaatttcacacagcacatcataatgttccgattccgtatccataattagcccgtcgaaatcgaaaatgacagcttttatcatccgtaaaacccctttctgtttcccttaacattatacgttaaaaacacttttcctcccagaatggttttgaaatcttttccaaaatattaaattccttattccttcacaaagttgtaaattatttctggataataccagtatttgacaaatctatgaaaaatatatgaactttttatgaaatttttatgaaacatggtactataaggggaaatgacaatacaatctatattattttattgtaaaataggttagcaccataataaaggtgaaaaaataaaagtaccacctttttttcatttgcttttatttgtacactattttaccaaaccggaaggagagaaaaaatgtgttgaggaaactaccttggaaattggtgctgcttttgtccctcacatcgctctttttgctcggcggatgtgacaccaaaattgcagtgctcgacccacaaggtccaatggcgcgggaacaatatcatttgattgtttactcatccatcttgatggcctttgtattcgtcgttgtccttgggttgtatctttatatggtgatcaaatacagggcgtcgcgtctgccggctgattataaaccgccgcaaatccacggccataaagtactggaaacggtatggaccgccatcccggtgctgttgattattgccattgccattccaaccgttaaagcaaactattcggtggaagaaacaccaaaatcgatgaaaaacgaaaagcctttaacagtttatgtcacgtcatcggaatggaaatggattttcagttatccggaacagggaattgaaacggttaactatgtaaacattccggctgggcggccaatcaattttgaattgacctcatctggtacgatggcttctttctggattcctgaacttggcggacagaaatacacgatgccgaacatgacgatgagactgattctggctgcagatcaccctggcgaatatacaggaagaaacgcaaacttcaacggggaaggctttgcaaagatggacttcgatgtgttggcccaaacgccgaaagattttaatgcgtgggtgaaggaagtcaaaagcagagcgcctcaaatgaaaaaatcggattatgaaaaactgattaaaaaagaaggcctcgtaggaagacagacttacaccgggacccatctaaaatgggataaaccggatgaacaaaaaagctattatgaagaatcggaaaaaggtgagaaacaaaatcaccaccatcaccacgatatgtccggtatggatatgagcggaaaataatcattggaataggaggaaaacagtgtgaaacttagtgattttttcgtcaccggtgaaccggccatatatgccgccgaagttggtatggcacttggcgcggccgctgtgatcttttctctaacctatttcaagaaatggaaatggttatggaaagaatggctgacaaccgttgaccataaaaaaatcgggattatgtacattatcgttgcggttttaatgttattccgcggcggtgtcgatgctttaatgatgagaacacagcttgcactgccgaaccagcatctgcttgatgcaaaccattacgacgggatctttacgacccacggggttgtcatgatcttatttatggcgatgccgtttttgttcggcctgattaacgttgctgttccgcttcaaatcggggcacgcgatgttgccttcccgcttttgaacgcattcagcttctgggcaatggttgcagggatgtgcctctttaacatttcattcattatcgggggctcccctactgccggctggacgaactacttcccgcttgcaggaacggaatttacaaaaggtgtcggaaacaactactatgcattgggtctgcagctttccgggatcgggacactggctacggccgtgaacttcattgtcacgattttgaaaatgcgggcgccaggcatgacattaatgaaaatgccgatgttcgtatggtctactttgattacttttatcatcgtgctttttgctttccctgttttgacagtggctttggcagaagtaacgtttgaccgtacttttggtgcgcacttctttaccatgggttcaggcggcagcccgatgttatgggcaaacttgttctggatctggggccacccggaagtgtacattgtgttgctgccatctcttgggatttacgcggacattatcgctacattctcgggtaaacgattgtttggatatgcctccatggtcgttgcgatggctggtatcgcattcttcagttatttcacatgggttcaccacttctttacaatggggaacacagcagtcgtaaactcgttcttctcgatctcaacgatgattatcgcgataccaacgggtgtcaaattatttaacgaaatctttacattgcataaagggaaaattagaacaacaacgcctatgctatggtcgcttgcctttatcccgacatttttgatcggcggggttacgggtgttatgctttccatggcagcagcagactatcaatatcacaattcatatttcctgattgcccacttccactatacattgattccggcagtcgcctatgcatgtttcgcagggctccactactggtatccgaaaatgttcggctatatgctgaatgaaaaactgggcaaaattacgttctggttgtggatggtcggctttaacctttgcttcctgccgcaattctttgtcggcctcgacggaatggcgcgccggatgtacacttatgaagcaggacttggctggacaggttggaacttcgcctctacagtaggtgcctatatcatggggattgggttcctcgtcctggcttggaacattgtttacagcattaaacatggcgttcgcgacacgaccggtgatccttgggatggccgcacattagattgggcaacccctacaccggttccggaatataactttgcgaaacagccggttgtctctacacttgatgcgttcgcagaatacaaagaaaacggcacaccgatttaccgggatgaagagtacaaaccgatccatatgccaaataactcggcaatgccatttttctccgctgtatcgatgggccttgcaggtttcggccttgtctggtcctggtggtggctcgccattctcggcggtttgatgatgctcggctgccttgcgtggagatcgtttgacccggataaagggcactatatcagtgtagaagaaatcattcgcacagaaaatacaagagcaggaggtgtaaaacgatgagcgacgaacatttggatacatcattgcccctcgaataccagcgcaatcaggaccgtttaaccattttcggtttctgggttttcctggcggctgaaatcactttgtttgcaacgctgtttgcaacgtattttacactccagcaccaaacagcaggcgggcctgttcagcaggacatctttgagctcaaaggtgtcctgattgaaacctttgtccttttgacaagcagttttacatgcggaattgccgtcttcaatatgcgcaaccggaataaaggcgcgatgctcggctggtttatcgttacccttcttctcggtttaactttcgtcggctttgaaatcaatgaatttgtcacgtacgttcatgatggggcaacactgccgacaagcgcattcctttccgcattctatgtattgctcggaacgcacggatgccacgtttccctcgggattttatggggaatatcgattattatacaactgatccgccgcggtttaacgccgatgacggcacgcaaatttttcgttgtaagtatttactggcacttccttgatgttgtctggatctttatcttcactttcgtttatttaggagggttgatgaaataatggagcatcattcaaaatatccgatcggccatgtcatcggttttctgctttcaatcgtattgacccttgtggcactgtatgttgctttgtataccaacctttctaaaacggcgatcatctggacaatcggattgtttgccttcctccaggctggcgtgcaattatttatgttcatgcacgtcaaagaaggcgaaaacggaaagatcaatgtcagcaatatgatctacagcatcatcattgcgatcgtcgttgtttacggaaccatctgggttatgcacttttaaccaaaaaaacctgcatccttttagcggatgcaggtttttttatggcttgtccggacagacgcatttgcaaatacggccaaatcggcgattcttcccgagggccggtttatggcttgaacgcatcaaccggtatcaacccggaccggatggatgccttttggcgctggttatgccgcacttattgcgctgtataaccgccgtccacgagcagggcaatgccggttacaaattgattttcactgaggaatacgatggcatgggcgatttcatccgcacgcccgagccggccgatcggatgccttgcgacaaggccgtcataaaaatcgccgagtgcttccttattcaccatgccggtttcaacataccccgggttcaccgcattcacgcgaatgccttttgatgcatattcaagggccagcgactttgtcatcaggttgacggcacctttgcttgcattgtaggcaaaagcacccggttcgccgacgtaccctaaaatagaggatgtattgacaatacagccaccgcctgttttcaacatttcacggatggcatatttcgaaccgaaaaatacaccgttttgattgacggaaataaccttttgatagtcttcaaagctcagttcatgggttgtagccatgacgccaatgccggcattattcaccataatatccactctgccgtaccggttgacggtttctgcgataagatcggcgacggactgttcatcagatgcatcggcacgaataaagcatacatccgctcctttttctttaagttccttttcaaccgctttgccgctttcttcgttgtaatcggaaatgaccactttcgcccctttttccgtaaaagcttttgcggttgcaagcccgatcccggaagcgccgcctgtgacaattgcaattttattttctaagctggccattatgattccctcccattgtgagtatgtacacattttcactataccgctaaaaagtaagcgctgtcaatttttatatctattttttgcgaaaaacagtttgcctggctggaatcgttcttcagccgttcactcccggttttccagcgaaaatcccggtaagcaaaaagcggctgcccggcacgcaacaagcattccgggcagccgcctccttattctgccactttttcttttctttctttgctccgtttttcgagaatcatctgtttgaagtttttctgtttgtcttttggccatgatttgaattctttcaggaacttttcgtaatttggcaggacatcatcgatcgcgccgtattgcttaatttcccctgcttccagccacatcgctttctcgcaaaatttctttacctggcccatcgagtggctgatgaaaaagatcgttttgcccgcatccttgaattcattcatcttctcaaaacatttatcggcaaatgtctggtcgccgactgataacgcctcgtcaatgacaagaatatcagggtcaacgttgaccgagatggcaaatccgagccgtgacttcatcccgcttgaatattttttaacaggctgatcaatgaactgcccgatatccgcaaattcaataatttgcggggttagctccttaatctgcttttttgtgaacccaagcatcaggcatttcagttcaatattttcaaggcctgacaattcattgtttaagccggagttgatggcaatcagcgatgtttcgccgtttaattcaatcgttccggttgtgggcggaataatgccggtaatcagattggacaaggttgatttgccggcgccgttaacgccgatcacgccgatgacatccccgttgctcgcctcaaaagaaatattctgcagggcgtaaaaatcatccccgtaaccgcccggcaaaatgatgtcgagaattttttccgaattgctccggtacattttatactttttcgaaacgtttttaaatctgacagatatgctcatagattagaactccctgttgtatattcaatacgattattataaagaaacaaatgccgttcgttaagcattatcgggattttttccttcgcgtaaaccataaaaacagacagacgccaatcatgattccgaagctgtcaaaagtgatgacatctataaaatgccctgttctgccgctgacaaaactttgatgccattcgtcaagattggcatagagaaaacttgccagaaagccggccggaactgcaaaacggacaggaaccaaaaccgtgcgcaaagttagaaggatcagcaaagtacagacggcatattccgccacatggcaggatttccggatccagaattcaataaaatcatacggcagcgttgacgtgacaagcgcacccccgtaataaaattcgattttcggcaatgtgtttgcatcgaggtgtaccagcttttccagttccggccgcatgtcctgttccttatagggctggttggagaaaagaaacatggcagccataaacaggatgcagagacctgcaagcaccagcgcgctttgttttttcttcatgagcaatggcaaagcctcctattcgctctttccattttacatgagtaagaaaaatgttgcatcctttttgggcgtttttcttccaacggacaaaaaaagaagccgcccttttcagccgtttccgcggaagaaaaaagcatggcatttgccctttatcataagcaaaaaaaccgggacggctcccggcctttttggccctgaaacgttatgctccttttgaaaagcgatatcgttttgaatggggtgatccgctctcctatttttgtaccgtaatcgttttagcgtcgctccaaatgccgtttttaacagcatacaacgacaattttgcgcctgccttttgctttttgattttcacggtgaacctgccattttttccggcaacagcatggccgattgccgtttttccggttttgacatagactttggacccgctaagtgcagttccggtcactttcgttgcgcctgctttaacgccctgtgcggacggtgccggcggttttacggttgtggctgcggcctttcctgtatggcgcgctgcatcggttgcatagacatacagttttctgccgatgctttgcggttgtatcttggccgcaaattccccgtttttaccggccttgccggttccgatcgttgttttgctggctttcaccgtgattttcgcatatggctctgctgtgccggttacctttttcgaaaaattggtgacagtccgcaaaccggaccggttggccggactctgttgaatcaaacagatacgtcccggccgaaaatgtgcatctgcccagaatataccatgccttatttttaaagtaaagaaaaatcaggctcattttttcgcaaagtttctgcaaatgatgcctgtttttgcagaaagggaaaatcgtactgaacctgcatagaagcgggaaagaagatccggcgtacatggcagggcggcaccaatacaggcggttcctgagagatggccggggcgctgaaaatgagccttgtcctttgttgtgagggagccgattatggtgttctgcatcaatctgccgcacggcgaaaaaacgccccggacgtcagatccgcccggggcaccctatgaatacaattaaagcatacggtttacgagattcatcacttcatcgcttaggcgtttgttccgttgttcgctctccgcgagactgcccgctttcacgccaaagtagaacttcactttcggttctgttccggacgggcgcatgcagaaccatgaaccgtcttcaaggaaaaatttcagtacattggactttggcagttcaatttttgacgtttctcccgttttcgcgttggtccgcacttgtgattgataatcctcgcgggcggataccgggatgcccgccacttctgttaacggatgggcacggaagttggcaaggatgccggcgattttttccgatccttcttttcctttcaaagtgagcgatgttaaggattccttatagtagccgtactgttcgaaaatgtcgagcaggccttcatacaatgtttttcccatcgacttatagtaagcggccacttcagcagcaaggaccgccgactgcaccgcatctttatcgcgcacaaaatcgccgattaaataaccgtagctttcttcatacccaaataagaaagtatgggcaccggttttttcaaactctttgattttttcaccgatgaatttaaaaccggtcaaagtgtcgatggtcgggatgccgaaagaccgggcaatatcgcggccgatttcagacgttacaatcgttttgatgacaataccgttttccggcagagtcccttgcttttgtttttgtgttaaaagataatggagcagtaatgcgcctgtctggttgccggttaaaacctcgtattttccttcatggttttttacggcaacgccgaggcggtcagtgtccggatccgtgccaagcaaaatgtccgcgccgatttcttcgccgtagcggatggcaagttcaaaagcggcatgttcttccggatttggcgattttactgttgagaactcggaatccggcagctcctgttcttttacaacggtgacgttttgaaaaccgaaattttcaaggccgcggcggaccgggagattgcctgtcccgtgcagcggcgtgtagacgattttgaaagaatctgcaaccgagctgatcacttccttgttttggcggagtttgatgagctggtcctggtaagctttgtctacattttcgccgatataaacgagcaagcctttttcgatcagatccttttcttcgccgacttcgacaagcagctcattttcgacacggttcacatagcctgtcagttcgtccgcttcttttggcggcatttgcccgccatccggcccgtaaactttgtagccgttgtattctttcgggttatggctcgctgtaatgacaacgccggcataagcgttcaagtaccggaccgcaaatgacaaaagcggcgtcggatggagggaatcaaataaataggctttgatcccgtgcttgccgagcgtttttgcggtttcaagggcaaactccggcgatttgcgccttgaatcgtaggcgatcgcgaccccacggtttatagcttcttccccctggtcgagaatgaagtttgccagcccttctgatgctttccggactgtataaatattcatgcggttcgtgccggcgcccagttccccgcgcataccgcccgttccgaactcaaggtttttataaaagcggtcttccagatttttttcatccccgcttacgccggatagttctgcttttaatgcggcatccagctctgcaaagcggttccatttttcataagaagttttccaatcagtgctcatgttggcctcctgtaaaaaattttctatttccatattagcataaatttgttgaaatcccagaccttaatgcatgagaaggcggattttcccgcatctaacttttatagcggccggaaaaaacgttgctgtagacccaccctgcacttcattgttatgatagagaaggaaaccaaatggaagtgaaagcaatgaatgaagaaaaataccaaaatttaaaattaggcgagtacggcattatgatcagcatggcggcctatttaagcctgtcggtgctgaaactagtgattgccttctatacggattcaaacgccctgaaggcagacgggctgaacaatattacggacatcctgtcttcgatcgccgtcctgatcgggctccgcctctcccggaaaccggcggaccgcgatcatccttacgggcactggaaagcggaaaacgtcgcctccatggttgcttctctcattatggtggcggtcggcatccaggtgctctatgatgccattgtctcgatcatacatggaaaatccgaatccccggatatggctgcggcatggaccggattcctttgtgccgccgtcatgttttttgtctatttgtacaataaacgattatcaaagcgcatcaatagccaggcggtgcgggcaagcgcgatggataatttgtccgatgcctgggtgagtatcggcgcgagcatcggcatcatcggttcgcagttccatcttccgtggcttgatccggcggctgcgattgttgtcggcttattgatttgcaaaaccgcctgggaaattttccgtgatacttcccatcttttaacagacggatttgatgagtcggagctggaaaattataaagcgaaagtactaagcgtagccggcgtccaaagtgtgaaggatattaaagcgcggcagtacggaaacaatacggtcattgatcttgtcatcggcgttgatccgtctcttgatttgcgccatgcccatgacatttccacaaaagtggagaattcactgatccgcgattgtgaagtatatgaggtcattgtgcatgtagagccggcggaaagttaaaacccggacttgcaagcacgccaactggtgatgcaggtacattcgaaggaaaggtgaaacccggacttgcaagcacgccagcaggtgcccttgtccattcaaccagtgccttttccggttgttaaaaaaggatgcgaataccacgcatcctttttcgttacaattttataattgtccgaccctgaagcttgccttccaaaatatccgaaagggcggccgggacttgctcaaggctgatttcccgaacaatttcactcgtcaaatgttccggtttaaaatcgctggcaagtttttcccaaattttcacccggagatccatcgggcaaaaaacagaatcgattccgagccagctgatagcgcgcccgagaaacggcgttacggtcgttgtgacttcccttccaccggtaagaccgctcgttgccaccgccccgccgtactggagtgtgctgatgatgtattgtgtcgttttcccgccgacaggatcgactgcagctgcccattcttttttgcgaatcgactggtcttcatggtccgtaacggcttccctgtcgaggatacgggccgcaccgagccgttttaaataggcgtgtgcctctttttttccggttgagaccgtgacttcataacccctttttgccaaaatgtcgacagcgacactgccgacaccgccgcttgccccggcaacaagcaccggcccctgtcccggtttgagcccgtggtcttccagtttttgcacggacagcgctgccgtaaagccggctgtccctaaaatcatggactctcttaacgtcagccctttcggaagcggcacgacccaggcagccggcacgcgcgccatttcactgaatccgccgaaatgcccggtgcccagcttatagcttgtgacgatcacttcatcgccttctttaaagcggctgtcagcggatgcaagcaccgttcccgccaaatcaattcccggtatgaatggatacgatttgacaaagtcccctttcacgccaacaagcgcatctttgtaattgacacttgaataggcgacttttacggtgacttccgcgtccggcagccggcccgtatcccattcctgtacggagagtaccggctgtgatgcattttccatgaccaatgcacgaaaagtttctttcaatgcaaagcacctctttttactcggctcttgtcaagtcaagattgtattggtaaacttcctgatctgaagaaagtttgtaccctttattcggattgtaatcgatgatgactttctcaccgagctgtttttggcttgccttcgacacaaggagcggaatgccataaacattaaataaatcgtcatcttcccgtttatggtcaatttttaaagaatgttccgcagcaattgtacagctcccgacaaagaccgcctcaatccggatgccttcgccttcttgaaattcaatttgtttgaattgggagagtgcagcgggtttgatatcaatttccatctttctcacctttcttttacaaatgatttcattatcgtacccgcttttcccttttgtaaaacaaaaatagcacatcttttattgtcggcaagtaccgggtatttccttcttttttcggcacgtgtctgaattcccgtcctgcacgccctgttcctttcagcgccggaaaaaggaggttatgaatgtttccatttatatcgcaaaatccggcacaaaaagatgaggctgccgaaatttcgcttccacagccgtttcggttcgcgcaacaatcggaacagccactcgatccgcaatttccggaacaaatacggggcgcgcggtacgtttccggatgcaaaatcaataaatgcgccgacgccgagccgtgctgtgcaagaaagttcctgatcgaagccggcaatgaatttttcctgcagcggaacgcccattccgacgagcagcacatcggcatgcgagcggttaatcatcgccacaatctcatgttttgattgaaaatacccgtggtggcagccggcaattttcaaatcgggataatctttgcggaaatgttgtatcgcactttgcagattcgtttcggtagcaccgagcacaaatacggagaagccgtttttttcacagcgctttaatattttcggcgtcaagtcggtaccgtttaaattgccggcaagcggaatgtcaaacagttttgcgccgatttcaatcccgaccccatcgttgagcagatagtcggcttcattgataattcggtagtagtcgcggtcggtttgggcgatattgtagcagtgcgcattcaaaaagaacacattggttttgatcccttcgtgtacccggctctcaaattcgtccaaaaattgttcttctgtaattacggtcaaatcgatattgccaaatgcctttttcaaaacaattttctccttagcacggtgaaatgtttccatgtttagtatatacgttccgtgcaccgccggcaatgtaaaatcccggtccgccaatgcctgggcaaaaagggaaaacccggcttgtggtcataaaaaagcaccctttgctgataccgtgttttttgcagcaagggcgatatacggttttgttcgagtgcgcagacggtggctaaggaaaggaacttgatggaagtccggacgtgaaacggtgctgccatgtgttaaacattggaaaattgcaaggaagcgccagccgaccgttaaaaaacggatacatgccgtcaaagctagtgctggttctgctccctgaattcttttggggtgagccccatatattttttaaaaagcaaagtatagtagctttggttgcaaaaatggaacagaagcgcaatttcggaaatagtaatatttgtatggagcaaaaaataaatcgattcttcaatccgctttttattaatataatccgtcaccgatacgccggtctcttttttaaacaagtgggacaagtagctcggattcaggtaaacatgtttcgccagcgattcaagcgtgatcacctgtaaaatattttcatgaatatatgccacagccatatgaatcgcatggctgtagcgatgttcttgtttccttgcctgctgcacggcttccgtaaaattgcgcagcatgctgtactcgagttcaaacagcttttcctgcgtctttatcctttcaatctccaaaatatgcgcatcgctgatgttaaaagcagtttccggcggcacgcccgcttcgatcgccgcccttgtaaacagcgtgcaaatacagatgagtgaattacggagcgagcggatcggttcttccgcaagttttgcccgctccagcgtattgatagttttcaaaacggattcggctgcttccactctcccttcttttacggcattcaacaactgcttttccatcatataaggcggatgaagaaaatactcgcgctggtgctcaacgcggtatgaaaggtagcgttcaataatggatttgctgatggcagactgtttcatcggagccgccccaatacctaaaaattttattatagatctaaagattctaatatcattgtatgcgcatacagggtaatattcaagtgtaatcatcaaaattaaagggggctttcgtatgtggaaaaaagcgggcgtgattttggcagcgcttacgctagttatcggcgtgctggccggctgcggcagcaattcaaactcgaaatcgagcaaaagcggcagttcctcgaaaaagattgtgttaaaattcgcggcacaaaatgacagcacacctgcgacaaaagcagtcattgcggcttttaacaaacaatcgaaaaagtaccaggtgaagtgggtacaaatgacgaatgactcggcacaaatgcacgaccaattgctgacttcgctctccagcggatcaagcgaatatgacatcatgtccatggacgttgtgtggggcggcgaatttgccggtgccggataccttgtcccgattgacaagaaaatgatggatgccaatttgacgaaagaccagttcaatgccggctcaatggcttccggaaactatgaagggaaacaatacacacttccattcttcccggaccttggcattctgtattaccgttccgatattgtcagcaaggaagatgctgcaaaactcgaaagcggggactacacctataaagaactcggggatatggctgcaaaatatgccggcaaaaacggaacgacaaacggctttgtttatcagtccaaacaatatgaaggcttaaccgtcaatgtgacagaattcacgaatcattacaaagatatcaaaggcggccttgagacgatgtatcaatttacaaaagcagcatgggcgccaaaagatttgctgaactatatggaacaacaaacgctggacagctttgcacaaggaaaatctgtcttcgcgcggaactggccgtaccagtatggcaccattaaaacaggcggagaaggcgtaaaagtggacatcaaaaatgttggcattgccccgcttccgaacggcggcgctgtcggcggctggcttctcggcatcaacaaaaactcaaaacatgtagaaggcgcatgggagtttgtaaaattcgtagccggcaaaaaagggcagaagattatgtccacaaaaggcggttacctgccgggatataatgatttgctgaatgatcctgatgtccaaaaacaaaacaaaatgctgaccatgccgggcttccaaaaagcgttgaaaacgacgattgcccgcccggtatccgcgaagtacagcaaagtatccgacacgatccaaattgcggcccacaaatatttaagcacaggccaaaatctggatgatgcagtcaaaacgatccaggacgcaacaggcaaataagcaaccgtccgggaacgcgttttactccctttccgtccccgggcgcctgcttttcataatggtttgatatcggcgaaaggctctattccatagagccttttttaaaaagaaatgagggggcgctgcataaactgtgcatcctccgtacgggaagaaacattacggtgaaaagaggtgccagcatcatgaagaagaaccgcttgcaggcttttttatttatccttccagccctgctgtttatcggcgtattctcgctgtggccgatttttcagtcactccgctataccttttttgattatcagctgaataaccagcaaaaatcggggctatacatgagcccgcgctataatttcgatttatttgacgaaacgcaaacgtatgtcaggctgtttctaacagaagaccgggaaaaaatcaccgacccggccgaccggcaaaaagtcgacaagctggtccatcgcgttgccgatgttgccaagcagtataaaggcagaaaaggcgtccaaaaaatcagccaggccgaccagaaaaagctgatgggcctttataccgactcatccaaactggtaaaggaaatcaatgccaaatacaatacgcaaaacggaaaaaatttatcaaaaattgttaaagatttcaaaagcagctttgtaccctccaacttcatcggcttcaagtcttataaagaagcattgcatgacaaacgactcgggcatgccttatggaataccgtgctctttaccgtcgtttcggttttccttgagttcgtcctcggcctcggcctcgccatgattatgaacaaagcgttcagagggcaaggcattgtaaggacaacttcgctgatcccgtgggcaattccgaccgcggttgccgcgctcatgtggagttatttgtatgacggcacaagcggtgttgtcgcgcattttttccaatccatagggctaatcagcgattcgcgcattctgctattaacgggatccggcgcgatggtatccacgatcttagccgacgtttggaaaacaacaccttatatggcccttttgctgcttgccggcctgcaaaacatttccaaagggttgtatgaagccgcatccattgacggcgcaacaaaaatccagcaatttttcaaaattacgctaccaatgctgaagccttctattttagtcgcactgctgttcaggacacttgacgcttttcgcgttttcgacctgatttacgttctgacaggcggcggtccgggcggggcaacagaaaccatgtctgtctacggttacaaaacgatgttcgggcaaaccaacttcggctacggctccgtcattgtcatcatcatgtttatttgcgtcgccatcatcgcaaccatttacattaaagtgctcggcgccaatctgatggataaaaactaaggagggatggccatgaaaacgaaccgcaaatggaatgtgctcatcatcgccctgattgccgtatttttatttgggatgatatttccgtttttctggatttttatcacctcctttaaaccttccggggaaatttttggcaacggggcttttcgggtctttgcccatcatccgacatgggaaaattacacgcagattttccaaaaagggatcctgacatcggtgaaaaacagttttatcgttgcgacaacgacaacggtttacattattttaattgccacgtttacggcttacgcgatttcacgctttgatttcaaagggaaaaacctgttgctcgggctgattctggcggtttcgatgttcccgcaaatgattgtcaccgggccgatttataatttgttcctgcatttgcatttaacgaactcgtatgcgattgtcctgccgtattcgacgatcaccctgccgactgcggtatggatcctggtgacgcatttcaaccagattccgctcgcacttgaagaatcggcaaaaattgacggtgcgacgccggtccagacgctgttccggattgtcttcccgcttgccgcgccaggtgtttttacaactgcgattattacattcattgccgcgtggaacgaatttttgctgacgattaccttaaattcggacgctaattatcatactgtgccggtcgcgatttctttcctccgcacccagttcgaaatactttggggacaggtcgctgccgctaccacagtcgtcacggtcccgactttgatcatcgtccttctgttccagaaacaaatcgtctccggccttacaacaggtggggtgaaagaataaaaatttccggcagtggaaaagttttccctcggtatagcgcgcgacattttccggaatcccgcctgccggtgtgtgacccctggatgaatacatgagccggcggtcgatccgatatgagcgaaaaaagggcttcccggccggaccataagaaaaaagggcgcttggcaccatgccatcttcgaatttggaatttttggaggaacagcgtatgacatgggaaatcacgaaacacgaattggacaaacaaatgctgctggtcaatgaaagcttatttgcactcgggaatggctatcttggcgtgcgcggaaactttgaagaaggctacccggaagaaatcccttctatccgcggcacatatttgaatgctttttatgacattacagaaatccagtacggggaaaaagcgtacggattcccggaaaccggtcagaaaatgctgaatgtgatcgatgcgcagaccatcgaaatttttcttggagaagaaaaagaacgcttttctctttttgaaggggaagttctcggtttttcccaaactttgcacatgaaacgcgggttttccgaacgcgccatccattggaaatcgccttccggaaaagaaatcaagctcactttttcacggttggtttcttttacacagcgggaactgtttgcgattcaagtgaaaatggagccggtaaacttttccgggccggtgcgggtgatttccactgtcaacggtgatgtgcaaaattatgtcgataaaaacgacccgcggaccggatctgcccatgcaaaaaagctggctgtgacaaaagtggcagaggacagaggcacgattgtactgcgtgtccgcacatttgcttccgggcttgaaatggcttgtgccgcaacccacgccgtttccgtctcttgcgaatgccattatgaacaagacgaacaaaaagtgcacgcaatcatcgatttcaaacacggcgagccggtgtcccttacaaaatttgcgatctatacggacacgctccgccacggggaccatatcgcagaaaaggcggcggccatcctaaaaagcatgcaaggcaaagatttttcagcactattacgggagcaggagcaatatttagccacttactggcaagcagcggacattgaaattgacggcgatccgaaactgcaggaagggatccgtttcaatctgtaccagctcctgcaatctgtcggaaaagacaccgccagcaatattgcggcaaaagggctgtccggggaaggttatgaagggcattacttttgggacacggagatttacattttcccggtgtttctgttgatccatccggaactcgcgcggcatttgctgctgtaccgctaccatatccttgaccacgcacgggcaagggcaaaagagatgggccatcaaaaaggtgcgctatttccgtggcggacgatttccggcacggaatgctcaccgtatttccctgccggcacagcgcagtatcatatcagcgcggacatcgcttacagttatatgcaatactggtatgccacccaagatcaggactttatgaagcaatacggcgtcgaaattctcgtggaaacggcgcggctttggcttgaggttggccattaccgggaaaaagacggcaaatttgcgattgaagatgtgaccgggccggatgagtacacagccatcgtcaacaacaattactatacaaatgtgatggcaaaatataatttgaaatcagctcacaaattttatcactggctgaaagaaacagatgatgcctattttgcggcatttgctgcacggcttggtttaacggacgaagaagcggcaagctggctgaaagcggcggatgcgatgtatctcccttatgatgaaaaacgcggcatccacaaacaggatgacagctttctcgataaagcggtctgggattttgaacatacgccgaaagaccattacccgctccttttgcattaccatccgctcacgatttaccggtaccaagtatgcaaacaggcagacacggtgctcgcgcattttttgctggaagacgaggcaaatccggaaacgatccgaaactcgtatcattattatgaaaaagtcacgacacacgattcatcactgtccacatgcattttcagcataatggcgtctaggctcggcgaagcggaaaaagcgtatcattattttatcgaaacagcccgccttgatcttgataacacacatggcaatacaaaggacggcctgcatatggccaatatgggcgggacatggctatcaatcgtgtacggattcggcggcgtccggatcaaagaaaacgggttttttctaaatcctaccattccggaacaatgggaccgctatttatttcgcctcacctaccaaaaccgcaagtttcaggtggaagtggcgcgccatgcgtttaaagtgacattgctggaaggagatgcgctggacatccatataggcggccgtacagaaacgttgaaaccaggcaggacggttacccggccgatttccggattgtgaatgcaggcgttcctttcctttacacaaaaaacagaaaaaagcggcgggacactttttacagtggtttcccgccgtttttatgttttctttcgggctttttcagcggcttctgtggtgcagtttttgtcatacgtacggacgggacgtgcctccattcccgtttcaaaatgagcccgggcgtctattttgaaacggggaatcccgccgatcagggcggattccctgcagccgtttgtccattatttcacggttgtgcccgctttcgtgtacgaaaaagcctgctcgaaatcggcaatcagatcatccggattctcgaggccaaccgataagcgcaacaagctgtcggagatgccgcgttttcttcggtcctcaggcggcattgcggcgtgggacatttttgccggataggacagaatcgattctacagcgccgaggctgacggcaaagaccggaatttttacatggctgacaaatgtccggagcgcttcctcatcttccagttcaaacgacaataccgcgcccggcccttgtgcctccagcttttgcagcgcatgctgcggatggtgcccgagccccggataatacacgtttcgcacaagcggatgcgcatcaagaaaatgtgcgattttcaccgctgactgctgcgattggagcagccgcacatgcaacgttttcaacccgcgcaaaacgagccatgcatcctggacgccgagcaccgccccgaatgaattttgcaaaaatccgaggcgcgctgccaatgcttcatcttttacaaccgcaagcccagcaacgacatcgctgtgccctgctaaaaatttcgtcgcgctgtgcagcacgatatccgccccgagttcaagcgggcgctgcagggcaggcgttaaaaaggtgttgtcgacaaaggtgagcgccccggtttcctttgccagttcactcaccgcacggatatccgtcacttttaaaagcgggtttgaaggggtttccacataaaaagccttcgtgttcgggcggacggcctgccgcacttcttcaaggttggtcatatctacaaatgtatgttcaataccaagccgggtcaggacttctgtcaccatccggaacgtgccgccatacacatcttcggtgatgacaacatggtcgcccgccgacaaaagcagaaacgcggttgaaatcgccgccatcccggaagcaaacgcgaaacctttgacaccgccttcgagttcggcgatgacatcctcgagcgcttccctcgttggattgagcgagcggctgtaatcgtatttaccgaactggtcaatgtccgcctggtggtatgtcgaagcatgctggatcggtacactcacagcaccggtcgccgggtctattttatggctgttatgtaaaagcctcgtttgaaaagaataatcttcatttgtcatcgtgtttgcaccccttcgtgaatgttggcaaaagctttttcaatatctgcaagcaaatcgcgttcattttcaattccgactgaaaagcgcaaaaggcaattgtctacgcctgaagcaatccgtttttcttccggaatgtcggcatgcgtctgtgtagccgggtaagtgataaaactttccgtcccaccgaggctttcggcaaatgtaatcaaagacaggccgcgtaaaaacgggtcgacccatgattcttcttttacacggaaagaaagcatcccgccgcggcccggatacagcacatcttttacatccggatgcgcgcttaaaaatgccgccacagcttttgcatttttttcgtgtttttccatcctaagcgccagcgttttcatgccgcgcatcagaagccacgaatcaaacggactgagggtggcgccggcaccgttatggtacagaaaaagctgctcgcaaagttcagcaccctttgccacgatcagaccggccagcacgtcgttatgcccgccaagatatttcgtcgcgctatggactacaatatcagcgccttctttaatcggctgctgcaaaagcggggtgtaaaaagtattgtctacaatcagcaggattccgtgccttttcgcaatttcagccactgcgccgatatccgtctgctgcatgagggggtttgtcggcgtttcgaggaaaatggctttcgttttcggggtgatttcttgttcaatattttccgggttgcacgtattcacgtacttacaacaaagcccccattttttatatccctgctccagcaggcggtaggtgccgccatataaatcatcactcacaatccactcatcgccggcctggaacaaagataaaacagtgaaaatcgcagccatgccggaactgcacgcaaacccgcggtccccgccctccagatccgcaatcgcttcttcaagcaactggcgcgtcgggttgccggtacgggaataatcgaaaccggttgactgcccaatgccttcgtggcggtaagcggtagaaaaataaacaggcgggttcaccgcacctgtcacgcggtcactgcggtttccgatttgtgcaagttttgtttctgtatgatacatgatggacactccctcacttaaaatcaaaaagccttctccaataagaagaaggccattcctttcgtgcatgaaccatcttcttatctttcaagttatgatcccataacttgcaggacttagcaccttttcaacgcgtaaaagcattgaaggttgctgaggcttcatcgggccattccctcaacctctcttgataagaaaacaccaatatgaaatttgccatcaacgccgcaaaagaaattacacaacgaacctaaaaattgcttacgttcaatttatccctttttttcggattcgtcaagctttttttaaattttgtttttcttatggataatccatatggtgagaaaataaaacagcaaagatgaaaggagaagcgtaatgactccgtctgtagtattgatatactcattcctgaattttgctgcactttctccattcactatattcggcacatccacaaatgtaaaagggatgatatgcataacagcatacaactttgtcttaaatccgctcatcatttcctcaaaacaaaaacaagccaccaaaacgagcatcagaagcaattgatttcgaataaaggtatttaaaaactgcgtgaaaacagaaataaataatagaagacataggattagtaaaagcgatctgcccaaaaaccgggcaattgaaatccacaatacttctgtcccgtttaaattgatcgccacagggtacttccaactccccaaatggcttatgatgctaccaataatgagcgcaacaaccaggataacaatcgtgatggcaaggctgtaaacaaatgaagtgaagattctcgcatccaatattttcttgagcttcactggcaaaacatttacaaaatgattaataccgccttgtttgtctcttgttgaaatatcaccaattaaaactgcaatgagaagaggcattaagaacgggaatacgtaaaaaagaatacgatatgtaaagttaatacccggggtttcgaacgactctattaccggatgaatattttgtttaagcagaatggtattgagctgtattgctttttctgtctgcggaacaatttttttattaccaaaaacaattgttccggcattaatcccagcaattaattttttatctaaagcgatctgcaatttcagttcttgcttccaatcccctgcttcatgagcttgtatttgttctgtacgaaggcgtaactcctcctgcaaacccgcaagtgctttcttctttgcttcactcttatttggatttgattccatgtgtgaaatggcattttccagtgaggatttgttatcctgatattcattgagcgggtccattctctttgctcccacgaaagtaaatgcaaacaaaatgaaaacaatcaaaatagcagcaataaaaacagtcaaattttttttatttctaatgaatcgcaatgtctctaatttgattagccccatttatcttcaccttcgtatatttcctcataaattagttggctgcctttttgccctatgaaaaatgatttaaatttcatgtcttgttcgaatgcctgatttaccacaaaggagcttttactcgaatctatctccgcccatacttcattggctgtggcatttttaatttcttcatctttaaatagggaaagaactttatccgcatcattcccattctctaacttaatgatgatgtatttattaaagtccggattattttttctgctttcgtaaaccattcttccttgctttaaaaagatgacacgatcacataattcatcaacattgttcagaatatgggaagaaaaaaatacaattttattttcatctctaagttgcttaatggatttgcttatcagtttaatattggatgggtccagcccattcatcggctcgtccatcaatagcaaatcacaagaactgatcaagcacatcccaaatagcagcctttgctgcatgccaagcgaatattttgaaacccttttgtcgatataggaacccatgcttaatttttcaataacagcgccacattcttgtttgctctcccataatctttgtacaagttttaaatgctctctccctgttaaatttggatacaatactgtatggtcttgcaaaaaaaatatttttttaaggattttttcccgatgcattttataattcatgccgtaaatactaatttcgccttttgaagcaggaatcaggttggatatcgcatttaaaagcgtcgtcttgccggatccatttggagcaaccaggccaataatctcccctggttcagcagaaaaacttatatcttccaaaatttttgacttctctatctctactgacacattgtttacccttaacaaaacaatccctcccccgttaattcacaagatcttatcacctattttaataggccgcagcgccattgtcaccgaaatttttgcgtggtgtcaccgaaaaaacaaactgctgctgcacatattggcggcaaccaccaaaaaaagcgggattctttatgaatccgctctatccagtcaaaaaattttttcttgttattttgcttattcttgttattttgcttatatagtctggaccaaatcctgaatatggagcatggcaaccggtttctggccggtaacaaccggaagcaccttgaaagcgtggtcttccattatccgcaatgcttccgctgccagctgatgctcactgacgcaaaccggatattttgtatacaaatctgctacttttttatccagtacttcatggccgtttaaaagctcacgccggatatcgccgtccgttaaaatgccggccagccgtccccgatcgtcaataactgaaacagcccccgcccccgcttccgtcatcataaataatgcttcctttatgccggtgtccattccggcaaccgggttcatccttttccgtttagccacatggccaaccgtgagaagcaaacgccggccaagcgagccaccgggatggaaaagcgcaaagttttcaggtttaaaatcccttgccttcaaaagggcaaccgcaatcgcatccccgagtgcaagcgtgacggtagttgtagaagtcggggcaaggccgagcgggcacgcttcctcaacttccccgatatccatcaccagattcgaacgccgcgccagtgtcgacttgcgtgaaccagaaatagcaatcatttttgcgccgatccttttgatggaagggatcatatttaatatttccgacgtttccccgctgttggaaatggcaatgaggatgtcttcttttgttatttttccaagatcgccgtgcagtgcttctcccgggtgaaggaaaaatgccggggtaccggtgcttgcaaatgtggaagcaagtttccggccgatgatgcccgatttccccattcctgtaaaaatgactctgccttcgcacgccaatatcatttcaatgccttcatttatacgaaaattgatccggtccttcagctttaaaatctcattggcctctttttccagcacttcacggacgctttcgacataattgatgcttcgtttgaaatcttttaacatcctattcacctccgttaatgaatgtttgctgccgtttgttcttttatcatgcgatcaatttcaataactggctttaacatttcttcaagatcatccagtttcaccatattcgggccatccgaccaggcctggtccggatcaggatgggcttctagaaacaacgcatcgatcccgcaagccgccgctgcccttgcgagatacgggacaaacgcacgctttccgcctgttgaagtcccatttccgcccggtatttggacactatgggtggcgtcaaacacgaccggataccctaatctgcgcatttccggaagtgcacgcatatccaccaccaggttattgtagccgaatgtcgaaccgcgttctgtaagaagaattttgtcggtgccggattcctccagtttttgaatgacgtttttcatatcccaaggcgccaaaaactgcccttttttgacattcacggttttgcccgtcgcggcggcggcaagcagcaaatcggtctggcggcaaaggaaagcggggatttgcagtatgtcgagcacttccccggctgcttttgcctggtgcggctcatgaatatcggacgtgaccggtacgccaaatacatttttaatccggtcaagtatttcgagccctttttccagtcccgggccccgtttggaaaaaatggatgatcggttggctttgtcgaaagaagctttaaaaacgaaaggaataccgagttttccggcaatggtttgaagggttgcggctgtttccatggccatcgtttcactttcaattacgcacgggccggcaatcaatacaagcggtagacgttggccgaaagctatccggctgttcagttggaccgttttcatttgctcactcctcatttttaagttttcacgtgtctttactccttctgctgcaggttacaaatattatcctttagaaaaccgcacagggcaaggaagatgtaaagaatattcacaaactttttgtttttatgtaaggttttctccaggaaatataaagcacaaaaccggacaagttttgtgctttataacgcggatggcgggtaaagtctccttcggggaaatggctgggaaaaatattcttcttacaaatggtggcgatacggggctcaattattttataaatgccattaactcatcagccgttttgcttttgatgattttttgcacaacagacctgttttcgataatcgaaatgagctttttatacatatcatctaaatccgtttgcgtgccttctttaatattcaacaaacaaacaaattgaaccatttgctgtccatgccaatggatagggctttttagcgtacatactgtccaaaacgtttccttcgttacgggcaccattggatggggaatggctacgagatttccaaaacaggttggcgtaatcgactccctttctaaaacaaggtttacataatccttcggtacaagcttctgcttatacagttcatcacataaaaatcgaatcacgctttccttatcctgcaatgccagttggagaaaaattcttgaaggatgtaaatatttttctgccacattttgcgtcctagataaaaaaccatttatagcttgaatgtctttgtcttccaaaaaagtattcacaacttggaccgggacgccaaaatcctcctttataggcacagtgctaatgatcaagtcaataaaagataaatcatatgatgataaattgtaataattaatcgtatcggcaatttcaatttcttggccatacaaattttgcaatcggtaggatagtaattttgcactccctacgcccgatgcgcaaacgattagtactttttttatttttttcttgtttaatttcattcgttcaagagcaacaccgatatgcagcgcaatataggcaatttcatcttcaaccacttccatttgcaaatactcttctatacatttgctggcaataatggcgccttcaaacgcagccgggtattttttctttatatcgtttaataacggattccggatattcattttgtaccgcaatcggttcattgcaggacggatatgcagcgttagcgcctgaataaactcgcggtcttggcgaaagtcccaattcaattcagcctttaaacgagctaacatacaatttataattgttccggcttcatcaaatttactaaactcggccagctccttcttgtgtaaaagtttggttcctaataaatgaacaataatataatcgatttctgtctcaggaaaagttaacgaagtaaaatcttcaacttcttttatgatttcgttcgccacaattttttcaaatggatgatcatcgaccagaacatcagccagctcttcaataacaaagccttcctgaattcttctgcaggcgatagcaatatgcgttgctaaattttccaaagatatatcagagatttcaattttatatttattaaccttttggacgattacttctttaatctttttaaatagttccggatcaatgagttgtaaacaattctccttcaaaaatgcctcctggttccgctccaacaataaattagataaacacaaacgtttcatatattcatcgccttcaacctttgaaccatagtgcgggcggttgattagctttaaatgatattgatcaagaatttcttttaccatctttaagtcattttgcaatgtcgataaagagacgaacatctcatctataaaactttcaattttaataaaatcggtttctaacaataaccggcgtaaaatatagagaactctcgtatctttatcagtgaagtcacccgctaaatgatgttcctccgtagaaatctcattgagtatttttgaaaaaagcccggcatctaatacttttacgctatatcccaatcctctggttgattcaatttgaaatccgtgtgatgctgtattattttgcatgagcttaatttcgtttcgaatcgttcggtcactgacgcctaattctcttgccatccagcttgcagtaacgggttcttttgacttagataaaaggattaatatatctttctgccgttttgataggatagccactgccaacaactcccttttacatggattactaagatttttggcaaaggaagagctgtagttttcgggaaaccaaccattttttcgggctgtgatgtaatcgttgaaaaaaccaatacttgatactttgcagcctgtcatatcgtagctttccttataactattgctttttcaccggggatttctattttcttcccgtatatgaaaaaatggagttttattgtaactccattttttcacgccatgattgaatatgattcttattgtaaacgttagaaaaacgaccgtcctaaaagttaaagctcttctccatttgtttttatgacatgcctataccattcaaatgactttttcttttttctttctaaagttccgttcccttcattatctttgtccacataaataaaaccgtaacgtttttccatttctcctgttccagcactcactaaatctatacatccccacggtgtgtaacccattaaatcaacaccatccagttcaaccgcctttttcatttccagaatatgatcgcgaaaatattgaatacggtaatcatcgttaatcgtgccatcctcttcaacgacatcccgcgcgccaaggccattttctacaataaatagagggatattgtacctttcatataaagcatttaacgagtaacgaaggccgaccggatcaatttgccaaccccaatcactggcttgaacataaggattgcgaacgacgcggccaaactctccatcaggctggctgtcttctacttcacgggcgctgactactttagacatataatagctaaatccaatgtaatctactgttccttctttaagaatttgttcatcttcctttgtatattcaatttcaaatccgtttctttcccagtattttttcgtataatcaggaatcgtcccacgaacatgtacatcaccaaagaaccaacgattatgcatcgcttccgtggcaagcatcacatcgtccggatgacaagaatatggatatacaggtacgaaagaaagcatgcaaccaatcttaaagtcaggattaattttgtggcctaatttaacgacttttgcgctggcaattaattcataaagcgctgcctggtacatggtttgtttccggttttcaccttcttcatatttaattcctgagtttgtgaagcttgcaaaatccatgctcgtatctgcttgattattgatttcgttaaaggtcatccagtattttactttatctttataacgtttcatgactgtctcagaaaatttcacaaaaaaatcaatacatttccggtttctaaaacccccatattttttcacaagatgataaggcaattcaaaatgagatagggtaataacaggttcgatatgatattttaataattcatcaaacaaatcatcgtaaaattgcaagccttcttcatttggctcatcatcgtccccgtttggaaaaattcttgtccaagcaatagaagtacggaaacatttaaaccccatttctgcgaacagtttaatatcttttttataacgggaatagaagtcgattgcttcatggttaggataatagtaacctcctaatacaccatccgtaatttgccgtggaacaccatgtcttcctgcagtcattacatcagcaacacttacaccttttccgcctttattccagccgccttcaagctggtgggctgctactgctccgccccataaaaagttttccggtaaaacgccttttgacattgtaaaccctccatcatttatcttatttggtttcctgaacgagaaaagttaaataagaaggcgattttcctatgaagaaccgccttctttcattcacccgcagtgcaacatcgttttcataggatatttctacatcttatttttctatttcaagatgaggatcagagtacagattctccgcctttttcttgctcaactaacttcttatcatatattctgatgaacggaagatatatgataaacgcgaccacaccacaaatgagtgagacaactggcgccataatgctcccacctgttccaatgaaagccccaataccgattggcgttggccatggcacttgtgcaataagtggcgcaacaatgtgcaatttaattgcaaaataaccaattgtagctgtagccataggcgctaagaaaaacgggatagccaggtatggattataaacaattggtaatccaaacaatattggttcattaatattaaagatgccaggagcaagggacgcttttcctagtattctcaattgctgtgaccgggccaaaaatgcaataaagatacataatcctaaagtcgacccggaaccgcccataatgacaaatgaattttggaactcgccggcgaatggaatatttgccccatgaatattggcttccatatttgccaaagtaattggcgtcaggaaggctccgataatattcgccccgtgaatacctacgatccagagtgcatggattaagaagtaaatcaccatcaatcccagccagctgcttgcgatattcgtaacaaagctaaatggaacagcgacaactttaaatatatctgtacctaaagctacaaaaataccattgatgattaagatcacaaaagcgactaaaaatgcagggattaaagctgtgaacgatctggataccccttccggaacagcttccggcattttaatcacccaattttgttttacacataaccggtacaactggacagcaataacagaaacaataatggccgtaaatatacctgaagaacctaaacggcttacaccactgtcgcccatttcccaaccgaaaataatatgagtcgtatcattcattttttggataagtgacatttttccattgcctgcaaccaattccggaatcgtcataaagaaagcaaacatggataataaagccccgtttagcgggtttacatttatcccttcttcttcagcatatatttttgtatactcataaccaataacaaggttgaaatataatgctaaaattcccattgttgctttatttgccagcatatacaagtcactaattctaaagaaagtattatcgaaaaagccttgcaaaaatgttaaagtctgtggcaatacgttcaacaccaagaacatggatcctacgattgtaaatggtattgaagccatcccggcagccattaccgcccggacaaatcgaaaagatgctactttccccataggacccatcagatacttttcaagaaaagtaaatgccttattttgttctgacataaagacccctcttttctattattaacgaatcgctttttcatactccatgatgcgttgaaaatgcttgtcttcatcatgtgtaatttggtataaccgataaaggataaaagcgcttaaaaatatcccggcaatcaaaacagttaaaattaatacttttgacttgttttgattgattaaaaatggatataaatgagcgaaagatgacgaaaaacaactcggcaacagcaaaatcacatttgcaatgagcaaagtcatgaaacaaaactttgtgtatttagcatgatttgtcgggctgctataaatctttacttgttccgcaacgctcaatatgacaacgatgatcaacgccaatggaagaaggtatagtaacgaatgactcataaccaatgaaattaaccaatatacattcgtaaagaaaaagattgcggtaacatatctgacaagcaaatatcggttatagtacatcgatttaagcatctggtttttttgatttttttcaaataatgctctttctacgtcattcataaaaatccctcatttattaaaaatatggctccccgctactcgttaaagcttaagcaatccattacctccaatccaaaagacatcttaacgggtatcttgcttgaagatcaccttccttccgactatccataaattttggcatttccgggtgagtgcattgtaaatagcgaagacccattttctcataagcaaatcaatcttttggcagttcttgtaagattaaatttcctaatttttcaacacccattggaatcggaatataggcttgtggcggaatgtttacaactggctttcctacgcgttctccggcttccttaagtttttgaaaatacatctttgtttgtgggctgactaaatataaatcaaagtcccccttttcaatcatcttattgccttcatttgctgaaacagcatcgacttcaatttccttaccttttgttttaaaaaattccgttgtcttcttcgccattaaagaagatgacatacctgctgcacaaataattaatgcttttttcatcataaatgcctccaattggttttttattgtgatttaaacttgcttatcaatgaattaatgacttccgttgcttttaatggcccgcttgtgccgccaatcatccatttttcaaacagcaaacttggcaaatttgttagcactttcgacattcaagttcatttgtttttttataaagttcaatgatttcttttgccaggtcaatcactgtcatggcattcattaaatggtcctgtgcgtgtataagcaatatactgatttcgaatttctccccactggcctccccctttattaggtctgtttgaaaacgatgagcgattgtcatggcttcgttggcttcttcaattttttgttcagctaatttaaactcacctgctttagcaagatttatggactccgcagctaagcttcgggcatttccgccatttaaaataatttgaaaactaatttcttctatgttcaatgtcatcacccttagtttaaaaattgtcgtttcttcaccctttttgtcgcataatatccatcattgttacttactgttgatcacaaagagtaacttgctgtaatccttaaacactgtttaatgctccgctttatcagccgcttaccttaattcaatattaatatggaaacggtttcgctttaacctaaactctttccttagcgcaacggaaatcattactggaaaaaatgaagtaacggaaaaaggaatccgggatcaagtttctactttctcgccattaacatgactgccacttttttcaataaagcatggcatcaagcttttagacatacctctttgtttatcgtacttaccaatcccggcctggcatttcaaaaaaggaaagtgcggcaagcagaaggcagtttgaagcattttaagaacctgcattaaaagttacaattggaaagattttctgtgcagaatgccttcatttcccgattaacggctgcagaagcgggtaatgatatagtacaaacaccaaaaggagggaccgttatggatcatgcaaaggcgttagtgataaagtttattatggtcgcagttgtgttgggcatcattttatccgccatcttcaacatgccgtttggcgatatgatcgccaccagtgtagtactgaccattcttgcatatgtcctgggagatttaatgattttcaaacgggaaaatgaacgcgaggaggatacgcaaagaaatatcatggcgaccgtcgccgattttgttctggcgtaccttgtcgtgtggctgatgggcagatcactcgccccggacatggacaatctgttatgggcggcgctggcttcgagcatcgtcattgcagccggcgaatggttcttccataaatatttacaccatcttttccatcacacgcctgaccgcgaatttaccggatacggcggtgactgattgaaaaaacggcagccggatgagctgccgttttttcgtattcctataaaaacttaccattcatcaataaatcatccaatcggcaagcatcaagttttttaatcactacgcaattttttcggccaagcaaaacttttactttctttcaccttaccgtaaccgttcttgttttgcttttgtttccggctctgtctttcgcgaaaatggaaagcttcgtgccttttttctgtttgctgattcttacactgtatgcgcctttggcatttactgtggctttgccgatctgtttgctgccgcggtatacatagacaactgctgatttttccgctttacccacaacatgcgtggacttcgttgtgacattgccggcagtcggcatgcctggtgccgttttgtcttttactataacttttactttgctgctttttaaaccggcctctgtataaacatagaggacggttccggctttttgctttgaaaccgggactttaaaatatcctttcccgtccgctgtgccgcgggcaagtatttttccgttcttcataatggctacttcgatccccgggtcggagctgccggaaatggatgtgctattatcgccgacagtccatactttcggtgttttcggttgctgcgccttgccgccgatacttcccgacaagagcgtatatgtcatatcccgtccttttccagacggaacggaaaagcggcttgctgaagacagctttttcacaaccgccccgccgccttttagcttcaatgaactgccgttgtaagttttaattcggagcggcttgaacgcggcatcccctttaaacccgtataatccgtttgtctgctttaacacgagcgcggcccggaaatcggtcataaactgcccgaaagtcaggttcgggtcaatgtattttcggatcacatcctcgatggctttttcattcgtgttcggatcgtccatgatttttttgaaaatggcatcgccttgtccgcattgaattttcaaatactccatgaacaaataggacaaggaataattggcaagcacatccccgttactatcccagtagagaagcgagtggccatttgtaattgaagcatcgttgttataatcatcaatccgatcggaaagcggctttccggtataaatttgctctgcggccatggacatcccttcgtcaatccatgtatcaaacgtatcccaatggtgctggacgaacactttctggttaaaagagatcatatgctgaaactcatgggcgagtgtcgaatacgcttcggttacatttttcgatgtccccgtccccataagcgggtacgtgtcaatataaaagatttccgacttgttggaagtgtcggcatcaaaaaggtcaagcgggtaaaaatagccggcaacatatccgcccgagccgtcaaatccgtcctggatgtcataacaaagaatattcactttcccatttccatcaacatcggatggcatgccgaaatattttgtatcgagcgcataaatacggttgtcaaattcttttccaagctgggcagcctgggcgtcgttcagctggttattgtatacccagacatccgcatgcggaccgctgtataaaagcttagcacttatttgataatctttattgctggcaagattggacacccagaattttttcgtatctcccacccggggaagacgggcccttttcgtatccatgcgaacggaatacttccgaaggcttaaatattttaatagatcaaatggcttctggtaatcaatccggtaaacgttgctctttaacttttgacggagcgctgccaggttcacaaccttgaaggtgccagtcggctctgtcgaaaggcttgaggcagactcgttgctgacaagtttataataatcctgagccgacgcgcttccgcctgcaccgaataccccggccggcagtataaacaatagcgatagtataataggcaaggataatgcccgtctgaacattctcaatgaaattcctcctgcacctttgtccgggcaacccggcaattttaaaaagttgcttctttcattctagcacagcaggccgaattttggctgtccggttcaggaaaaagaagagcggagttttttaaccgtccttgttcccatttgcttggctgtttcatcctgctgagcggattcttttgcaacagcaggggccgtaccgctttttgaaaagacgttttttgtgcaacctttgggagaatttcttaagggccgccctgcacactttgggggcatgtctgttaaagcagcgggaaatttttcatattcccgctggatggtggagttttcggccgcggctgtagccctggcgctactgtttccatttcatttacaaaagtcctgtcatatggttcggctttgtttaaccaagaggattattttctaaaacgattgtcctgcctctgttgcactgcccgcctcctctccctgtttctctcttttcaacaaaaaagtacccttttttctattcagccgctatataaggagtgaaagggggtgagcgggaatggcacaagtccatttaacaagttcccgcatttcattaatctttgataacggggtgaatgaaaatggaaaaccggtaaccaaagcgaagtcgttcgccaatgtggctgcctctgcaacacccgatgcgatccggcaatttgcagacgcatatgcttcactgcagcaaaaagcgctggtccgtgtaacacgcactgacttgaacgatatcagtgagtgaaataaaaaaagggggaatggatagatgaaaactttggaacttcagtttttaacgcaggataacaaaacagtgagggttgcagtcgatgagccggcagagcccatcgatacggtgaaagtgaaaaacgccatggctcagatgctcggctcaggcgtgctggtcagctcatccggcacggcgctctccagcatgaaaggtgcacgtcttattgagcaaaacattactgaatatacactggcgtaatcttttgcccccggttcccgttttcggaacgggggctcttgattttaaagggggagaggagaaatgcatgaaatggtgtcgctcatcagtgaagtcgggtttccggtcgctgtcaccgtctttttgctgtaccggattgaggccaagcttgatgcggtgattgaatcgatccaaaacctgccggaacggatgaaggggatctgaaagggaggggcttatgtgcaagcccctccctttttccggatggatcatttcccggtccggtcgttattcatttgtttagtcacatacctgcaattgctccatttccgcaaaatccacgctgcaaaggatatatttcgacgaaggcagcccaccaagcctgcatttcacttcttcactcatcttccggtaacgctcagccgcgggctcccggctcagaccgattatttttatacaggcttcgctttctttaagtttgtaaaatgcgccggcaaactgcttctgttacttcttctgttgttgccgttccgccgatgtccgaggctttgatgcctttttcaatcgtccattcgattgcatccattatcgtttcacccatttctgtttcgccaaaataatcgagcatcattttagctgtccaaatttggcctattgggttggcaatgccttttcctgcaatatccggcgccgagccgtggacaggttcaaacatggaaggatatttcccgtccaaattgatgttcgcggacggcgcaatgccgatactgcccataatcgcgccgccaatatctgttaaaaatatccccgaataaattgctcgcaacaatgacatcaaaagtctccggcttcatcaccagaaaagcagacagcgcatcaatatgcatgctgtttacagccacatccggatagccagcctttacctggctgaacacctcgtcccaaaaaggcattgtgtggaaaatgccgtttgatttcgttgcactggtcaggcgtcggctgcgtttttgcgccagttcaaacgcatatcgcatcgcccgctctgttccttttcttgtaaaaattgcattctggatcgcaatttcgtcttcactgcgataaattctgccgccaacctcgctgtactccccttcactgttttcacgcacgacaatgaaatcaaaatctttcgggtcccttaacggggactgcagccctttgaaatactttgcagtccggatattcagcacctgttcgaagccgcgccggattttcagcaaaaggccccaaagcgacacatgatccggcacaagccttggattgccgactgccccgagaaaaatagcctcataatcttttaaaatctcaagcccgttatccggcatcatttttccctgatcaagataataatcacagccccacgggaacgccgtgaactcgaaccggattccgccatgccgttccgctgctgcatgcaatacacggatggcagccggcaccacctcttttccaatcccgtcgcccgagatcgccgcgatatggtatgttttcattctaatcccctccgttaaagcgctcccaattatattcattttaccataagcatgaaaatgaaatgctttatcatcccttaaaatcaagattcttattccgttgctgcccccgctgcgccaagcgggtaatgataaacaacatacgatcaacatggtgattttcagaagatgaatgaacggcatatcgctttaacctaatgtgccaagccattgtatggggaaaggtaaaaaatataggcaatgagaaaacagctcattgccttttgattggctaatttgtacgcgaacagatcgggcacgccctccgaatttttttcgctggcgttcgagatacttgtcactgctgtttgatcactgactttttcagcgaatggccgcgggcacgccgctcattcctatttgcatcaaatttttccggttaacggcagcgggcagcaaacgggcactgctgccgctattctcccttcgattctgcattccccggcacgcctgttttcaacattggaaaaacaaagcacagcccgataatgaaaaacaacgcagcaagttcgaaaacagccgtgatcgaaaaccattccttcaatgcccccgcaaggctcatggtcaccaccatggagccagtgaaaagcgggctcaaaatgccgttcaccctgccaataaaatcggattccgtattttgcaggatcagcgtgttaatgccgatctggatgctcggcatgaaaaagcccgaaacgagttcggcggcgagtgtcaaccaaagcgaagtcgaagcaccgattaccgcaagcccaatggcatttgcaagcataccggtgaacagcattttttgcggtgaagcagattttgaaaaggccatggaaaaagccccgcctgtaatcatcccaatgccattcaccatcacaagccattgcaggttctctttcggcaggccgagacggtccgttacgagaaaaatattcatcggctggataaaaccgacgccaagcccggccgccagaaaaccaagtcccagcagtcgcaattcctttttagacaaaacatagcgaatcccgctcttcatttcctggaaaatattcgacactttttccttctttttcatggcctggtctttcgggataaatgacaaactcgcggcggaaaacaggaaagcgagaccggttatcaaaatagaataatcgattccaaacctttcataggcaaacgtgccgaccaccgggccaagaatcataaaaacagcaaaaatggtctggtaaacggccattgcctgctggatcaggcgttcctcaagatgcattttaaacagtttcatcccggacggttgcgaaaactgcgacaaaatcgaggaaatcagtgttgcaaaaaagacggactgccacgagccaaaaacaagcgcgccgatgacgccaaaaatggacacggcactcagcaaatcacaccaaaccattgttttcttcggctgccagcggtccgcaaatgtgccgccgataaaactaaaaatgaaaatgggcaggaactccgccactgaaatcatggaaacggcaaacgggtcgccgtttgttttttctgtcacaaacaacaggacggcaaaattccgcacccatatgcccacctgcaaaaacaacgcggatacaaataccatccggacaaaccgatttctcaaaagctctcccacaagcgcccccctctggtcaaatctgtctcatatcgtgccattatcataccgaaattgaaagccttaagcaatacagaagcacccgtgtaaaacagagtgcgaaaaaatgcatgcaaacttgggaaacggaagcccgcaggcaaaaggtgaaaaaaatcggcgcatttggccgcgtgctccttttttccttcgtccagtcccttctcatgcctgcactcaaaacagacatctattctgcttcgcccgggcctggcattttcatgtctccatacgtgcctctcctctttttcgttccctcacgcgtcccaatccaaaccgtttttcttgcggccattttcgctacatttcattcacgcccaattcctcttcttttccccataaataacaagagaaaggccggaccattgcataaacgaaaaatccccgttaacaatttggaaaaaccatgatatgatagcgattagattaaataaaaaattcaaagaaaagggtcgaaaaaatgaagaagaaaatattcatcacactcgggattctcttagcgatcatcgtgatcgggggcggagggttcgcctattacgtctaccattctgtccaaaatgccgcagataaaatgtatgacagcaaatccgtgaaaccatccgagaaaaacactgaaaaaatcaaaagtgaaaaaccaatttccattcttttactcggcgtagatgagcgggccggagatgtaggaagatccgatacgctcattattcttacactgaacccgcaaaagaaagccatgcagatgatctccattccgcgtgacacgaggacagaaatcgtgggcaagggaacattgaataagataaatgcagcttatgcttacggcgggccaaaaatggcactggatacggtaaacaaatttgctaatttaaaccttgaccagtacatacgcttgaatatggaaggattggctgaccttgtagatgctgtcggcggtgtaaccgtctacaataaaatcagctggcatgacgaagggtattataaaaaaggctactattacgccaaaggaaacattacattggataccggcaaaaaagcgctcggttatgtaagaatgcgccaccttgatcctcaaggtgactttggccgtaaccagcgccagcgtgacgtcattatggccgtcattaacaaagcggcgaccatccagtctttctcgcgttatcaggaaatcctggctgcgatccagaacaatgtcaaaacaaacctgacacttgatgatatgaaaaacatcgcgatgaactaccgcgactgccgccaaaatacgacagactatgaagttaaaggcaacagtacaaccattgatggcatttactacctcaatgtcagccaggcagaacgcgacaaggtccacaacatggtgaccaatatggaacaataaagacaggcaggccccgttgtccggagcctgcccttttcaatttttatttttgcttttcctgcggttttaccggagatctttccggctctatgtctttatgatgatgctgtttttcctgttgttccggcgagtcgccttttttgtccttgttgtaatccatttggtgccctcctcccggttggattgatgttccttagcatcaatgcctgtctattgtaaaaatacccggtaactgcatatgctaaacaaagtggaaaggctgcccgctttggcggaacaaaaaatgtctattcggaaaaagcgaaggcaatggatcccgatagctgcaacggataaccaggggcttagatggaaggtgatccggccaccgcttttgttttttaccagctttccattcaaacgggagcaaaggcaatataacctgttacctaccgcagattcgtgccggcacctgcccccggccggagcgaaggtaacctgcacttacaaaagctaccgtggaaaacggaacgctcaaaacagcctgaacaaaacccatattacaaaagcccataccggaatggacaagccaatgccaatcagacagcctttcgcaaaatctccgtcttttccattcatctcttcattttcctttttaagtaataggatgaacattattataacaacccatccccttaaaaccaagtaatcattgacaggaacgtacgtttgtttatataatggaaacaggtgatccgtatgccgcaaatcttaaccgaggaagaagaaaagctgatcgaggcatttatcctcctgccgcttgccaaaaggacgctggaacgggaccagagagcgatccgggcaagcctgttaaaatttaaagagccttatctttttgcgacggaccaaatgctcttgcaaatttcatcctgcctcgctcaggtcaaacgggaagccggcagaaaaaagatgcgtttttacaaacggaatgacctttcctataccgtgtttgtgcgcggctggcggtttgaaaagaattaccacccacaaatagcagcggagtgggttaaaaaccgaatcaccagtttcttcctcccgttgcgcctgccttttgaagaccggtaaggagcttgcgaaactcagcagcttcaaggaacgccgcccgggccgtaaagggcgccaaaacgcctattcatgaaacattccagggatacatgggattgaataccgctgataaaacattccggcatacacgggatattgaagaccgccgggtgataaggagacgccgccctctttttaaagagcgtgaaaaaaaaatcccaatatacgaatgacaaacagccaggtaagcttggagaacccgggagcccggaacttttacatgcccggaaatcccttttgcagttcctccccgttaagtgcttgttttcttccactttttaaaactttcttccagacgggaaaacccttttttcatttcctcatcactgcagtaggcgaaacaaagacggatttttgtgtttcgcccgcgctcaagcgtaaaggcatcacccggcacaaacacggcgccgtcctgtgccgccattttcatccattccgttacaccaccttttttgacatcgatccagtaaaacagcccgccggccggttcagctccttcccattgctccgtctcgtgcatatgctgtaaaaaccgttttgtccagtctttccgtttttcataaaagtgtttttgttttgcaagaatctgcggccagttttcggaagaaatgagttttcccgccagcatctggttcatgggcgatgtgcaggcgtctgttacctgcttaaactgttcaagttttttcagaaaggctgggtgcgcgagaataaagccggtccgcatcgccggcgccataacttttgaaaaactgtacaggtatatggttctttcttttaagggatcgagttcgaacaaggaaggagggcggccgtgaaacagcagatcacggtacggatcatcttctataatgataaaatcatactggtaagcaagttcaatgagttttttccgtttttcgagagaggtggtgacgccggttgggttttgagcattcggaataatataaagcgctttcaatcttcttgtttgcaatgttttttcaagaaaatcgacatccaaaccgtcttgttcaagcggaatgccgaccgccttgagccggtactggtgcaccgccgaaaaggcaatggaatacgtgtacatttccattgcaaaaccgtccccttcatccagcagcattctgcagacaaggtcaaccccctgtgtattgccgtttgtcgccatgatatagctttccggaatattttccgttttagagataacatccacatacggcccaaacccttttgcactgcaatactcatacaggcgtgccggatctgcctcaaagatttcattcatgatgcgctgcagttcttttttcgggatcatgccgccatttggcatgccgacgctgaaaaataccggatcccggacagccggctcgatgctgtccatatacacatcaatcgcattttctttaatcttgccgctcaacgctgaaaacatttgcttcatcgccgccgcaccccgctttccatttgctgaaaaattgcctataccctatgtatatgggaaagcgcggaggaaagtgacacaaaaaataaagcatgaaatcagacaagaagacaaggtagcaatagtatatccaggccgcatgcccttgtcatccacacggaacatcagccgagaaattcacaccacctcatgtttccagctgttgtgcttcggtattatcctgtcatcgaaagcccgaagtcgtacgaatcggcgcaatacaaaagcctgttctgcttgaaaaatctttcaaagcggaacaggctttaaatttcctctcattctcaggtgccaatatcaagggagccggactaccccaaaacagatcccctgctgaagaaaagggccggatttgcgttcatgaaaacagattggttaacgcagaaaatcctttagactgttttccacaaactgcaaatggtcgatcatggccttgcgcgctttttcgctgtccttttcttcgatggctaccctgattctttcatgttgctcatacaaggcgcccaatgtggaaggatcagaaaaaagaagcattctgcgcgtttctttcattgcatcctccatcgtctcagcaacctggttcatcagcccggcaagaatcggattttgtacagcctggacaatggcaagatggaaggcaagatctgctttttcaccgagttcttcgttccccgtcgcccgcttcatatctgcgagcgcctgccttatcctttccagatcagcttcggtccgtttgacagcggccgtggcggctgctccggcttcaagaatcttccggacttcaagcagatttgccacatcttcctgattcatcaggactgcctgcgaaatgggatacgaaatcccgctcgcatcaaagttacggacaaacgttccctctccctgttttagctcaatatagccgagcgcccttagtgacgttaacgcttctcttatagccgatctccccacggaaaacttttctgccaaaagtggcaccggatcaagcttatccccgggcttaagctccccgttttggatcatctctatcaattcatttgccacttgttcataaatttttgcaggtttaatttttttatatttcatgttttctcctcttatcccttttctatattttatgaataacagcaatccggaaaaatagcaaacaaaaattttaaaaaaagagttgttttttctttttattatacttatactttttaacgtgtaaaccttatcatctgatgactatttcatctaatgaccttaaaaattgcaattgggatggattggagaaaatttttcaaaaaggagtggagattgttggagtacgtacaaaattttattccgcttaaggggcatttgtttttatccgcactgattgctgcctttccgattctgtttttcttctgggcactcgccattaaaaaaatggcggcacatcttgcaagccttgccacgctggtgattgcgctgctgatttctgtaatcgtttacagaatgccggccgtactgccggttatgtcagctacccaggggattgtgtatgggattctaccgattgcctggatcattatcaattctgtgtttttatataaattgacggtcaaaaccggccagtttgatgtgatccgcaactcggtcgtatcgatcacggaagacaggagattgcaagctttattgattgcgttttcatttggcgcttttttggaaggttgtgccgggtttggcgcgccggttgcgattaccgctgccctgcttgtcgggctcggattcaatccgctttatgcagccggcatctgcttattggccaacactgcaccggtagcatttggcgcaatcgggtcccctgtaattgcgatggcagggccgaccggtgtttctgcactggaaatttcaaaaatgatcgggcgacaattgccgcttatttccatgttcattccgctttatctcatcattgtcatggcgggctttaaaaaagcaatggaagtgctgccggcgcttattgtatcaggcttgtcctttgccttgacgcagttctttgcttccaattttctggggccggaactgccggacgttttatcagcactcgtatctttggttgtccttgccgtcttcctaaaattttggaagccgaaaaacatattctattttgagcatgaagaggctgccgccgcgctcgaaacgccgcctgtttccaatacaggcgggcaaattgcgaaagcatggtcgccatttattgtcctgacggttttgatcaccatctggggcatcccgcagatcaaacttgcgctcaccgggcagtatgccggagcgaacccggttttaaaggctctaaacccgatcggcggagcggcttcgttcagcgggaatgtgccatttttaaacaatcatattatcaatggctcgcacaccccgattgcggccatgtataagctggatctgcttggcactgcaggcacagcgatttttatcgcagccattgtcacgaagtttcttttaaaaattacatggaaagcctggtttgccgcattctttgaaacgttaaaagaattgaagtttccgattcttaccattttgttcattgtcggctttgcgtatgtcatgaatgcttccggcatgattactacattggcattggcgctcgccaaaacagccgctttgttcccgtttttctcgccggtacttggctggctcggcgttttcattaccggatcggacacctcgtccaatgttttgtttggcacgcttcagcaagtttcagctcagtctgtcggcatgaacccgctgcttgccattgcggccaattcatccgggggtgtcacgggaaaaatgatttctccgcagtcgattgccgttgcctgcgctgcaaccgggctgattggcagggaagcacaactgctgagattcacagtcaagcacagtatgtttttgcttttcatcatttgtctgctcaccttcctgcaatccaacatcctttcctggatggtgccttaatcagaaaccccgctgcggacatttcgcggcggggtgttttgtgttcgatcacaggattccgggcaggtaattgaaggtgcttccccaatgttagatagccagattttatgttcgattgcaggattccggcagccagtgggagcatgactcggtggaaaacccgtggcgggacattttgatgaagctctgtagcgaacgggcggttttgcacgcgtatggcagccgatgtttaaaaactttttcgcacgggtattcaaatgacaacacgaaacgaaaggagcatggccgatgccacatacaggtgaaacaccgggaaaaggcgagtataaatgcaaaaactgcggggaacagattacgctggatgaagataaggacaggctccctccatgcccgaactgccacgaaacggagtatacggaagcgtgaaaaatggaaaaatcatacaaagagcagctgtcatcatgcagctgctcttttacagatggttattctaaatttaaagcagtgtcttttttaaacagtttcagtacaataagatagacaatgccgattgccagccaaataaagccaagtttcttggagagcggatcaaggttaatccatacatagccgataaccgcaaacccaatcaacggcattagcaaatgtgccacatagtttttgctttttttcttcctcagaaagtaattcatgactgataaatgcagaaacaggaatgatgaaagtgcaccaaagtttacaacggaagatagctttccaatttgtgatgaaaagaatgccgtgacaatgacagaaacgaccgcaatcaaaagtgtactaagatacggcgtctggaatttcgggtgaacctttgcaagaaaaccaggcagttttcggtcacgggccatactgtataaaatgcgcgaaatggccgcctgtgcaacaagcgcattggcaatcccccatgaaaaagcggttgcgacaatcgtcaatactttgagccatgttccgcctgcaatctcagcgatttgataaaatgctgtatcggggtttttaaacgcatgataatctggccatattaaagcagccacccatgtttggatgataaaaagtgcaccaacggctaacaatgaataaacacaagcttttccaatcgatttgcttccatcctttgtttcttctgccaacgtggaaatcccgtcaaatcctagaaaacttaatacggcaatggacaccgctcccattaccacattcatgctgaaatggctatggtcatacagtggcttcattgtaaagtccgcaccgttaatgcccttaataattgccgtaacgcctaccgctagaaaaattgccagcacaattaattcaagtattacaataattttattggcttttgctgtgaactctatcccccgaacattaattaccgtattaattgcaataaacagtacagcccaaactacaatcggaatttgtggaacaatatcatgcaaggcagaagcactgacgaggtacagcaatgccggcacaaaaatatagtccagtaaaatcagccagcctgcaataaagcccactgaatcattgatgcctctttgtgcataagagtaaacagacccggcgatggggaaagcttctgacatccgtgcataactgaatgcggtaaaaatcattcccaccattccaattaagtaagtcagcgccaccataccgtttgaaccttgagcaaccgaaccgtaaatgccaaatggcgcaatcggcaccataaataccataccgtatatgagtaaatcccagaaagataaagaccgtttcagctcctgcttataaacaggctgctgttccaagcttgcaactgcttgttctgccatttgcccgcctcctaaaagatttcttttattcctagttgatgaacgatcaattttggcacgaacattctcgctgttctcagcgggtcaacaatctggctgacctgtacgtccccggctgcgcttaataacatcgtaacatcactaaccggtaagccggatcgcttggccaaataatgaaccatttcttttaccgccccctctgctgcttcatccagcgtcggctttgacacgataaaagcaaagccgtcttgattttcaacaacaggggtatgaatggtttgcccttttatgacagtcagaacgacggttaccctcgctggaatctcaacgccggatacgcacacttctccatctcccattgaagcgtggacatcccctaaagaaaacaacgcaccttcatggaataccgggaagtacaacgttgcaccctccgtaattaaagtggtatccatattgccgccatgttctcccggtgtaccacaatttacttctccttcatggggggcaaccccaatcacaccaatcattggcctcaatgggaaatgaatattttcattaaaagctaccatgtcattttcaatttgaatttttttaatcgaaaagtctgtaatttcattccctaaaacgccaagttccggtcccgttaccatcgtgccttcttgacccagttcaattttcttaatttctacctttaaaatatctccaggtgctgcaccttccacatagaccggaccggttgccggattaatctgattccaatcaatagcatgataagctgttttttcgctttcaatttgattcaaaaagcaatcgtacgtttccaccacaatcttctctcctgattcaacacacagagcaggtttgttttttgcgctcattgaatagacatacgtctcttttgtaagtagatgttccatattctcagcctccttgtgttacatcttaaaatatttcgaagattattttttataaaatctttacattattttattaaatctttactctttgctgtcagaaacactgccaagcctgttataagggtgcctgctacagtcactgcaagcccggcagtaaacttaccggtacagacagcaattccataaccaagcatcccggtaatacaaccggataccggaacccggaccgtcctccttttttccccgacaagcaaagcataaaatggaaacgatacagctacataaaacaaaaagtaaaatttccataaatagaccatgtgatttaccaatatggttgaacagagcaaaaccaacaggacaaaaaggagaaaaacaaaaaaatattttttgcgattttgaatgatccatttttccccaaaaatatatacaaatataatagctagagaaaagatcgaaatcatggtttcatttaacatactgaacaaccagacaatcgtaatcattgtccgaatgaaaggggaaaacggagcggaaaaaatggcttggcccagctctgttaatgtcgtgatatgaaaccggcttaataaatatacggtaaagatcatggccgaaagcggcacactagaaaagcagaaaaaagccagccgcactgagttttgcttgtaattttgcttggtcgaacaaatgacttgccataaaaacaaatgggagattaacaatccaattaaggccataagaaaagctactgcaaaaagaaagatatttggtgaatgcggaaaaagcattgtaccgtagtcttgataaacatggtgaatcccttcccttagatagaaaaacgatgggataaaaaaaagaatgaacccgcacaagatcaaaaatgaatagccagttctgtaaataacatgcatgccgcccaatccggcaacaataaaacaaaatagtgctgcaaacccggtaagcatgtaagaaggcatgtgaaaatactcgaaaaaaatatgcccaccaatagatagctgcaatatgagcccttcaaggtttgcaaccagtagtataaagaatgcaaatttaaagcctttaggtgttaatctgtttttataggcgtccaataatgtcggcacactccggctgtttaattgaatacgtttagtcaaatgctgcacacatagataagccaaatataaaatgattgtaaaagcaaagaaactattaatgaaaccaaagtggaagatgctaaagatcggaacagccagcaacgtttgcgtaaataaggatatccacaacaaaacggtgccttttttcatgccaaaacccacggccggaaatattgattgaagaaagccctggcggttaatttcctcaaggttaaaaacgataaccgcagcaaatgtaaacaaaatgatgtaccaatcaatcatgatgcaatttctccctgtattgtgttggtgtttccagcacgtgttttttaaaggattggctaaaatgataaatcgaagcaaaacctgtttcttccgctattttttgaatggaccattcggggtgtgctttaagaaaaactttcgccatctcaatccggtatttaatcaaatactcctgaaaactcatcccaagttctttggaaaatttccggcttaaataatttggggaaacatgcacctggcttgcaagatcagccaaattgatttttgaatgaaagtcttcccggataattcgaattacttcctgtatgtcagaggacaatccttcaatataaccatatttattcacatagttttcaagcatccggtacagttcttctgtgataatcggtttaacaagataatcaaaaacatgcagtttaatggcatgctgtgcatattggaaatctgcatgagctgttatcatcacacattccgatttataattctcccttatatatgcacataattccaatccactttcccctggcaaacggatatccaagaaagataaatcaatcggatgattttccagcatcttttttgcctgcactgcatcttcggcttcaaacagctcccactctggataacgttgccggattaaaaacacgagttgctccaattcaagtatttcatcatcaacaattaatatattcatacttttccctccggtgtatacggccatttgactgttaaaatcgtactcccagcctctctgttgatagataattctgaatgtaaatcatagattaattctaatcgcctcttaacattgataagccctacccctaaaacgccgaaactggcattttctgaccctggcccgttatctgccacaaacagtatcacccaatttccttctctttccaatccaatttgcaaatacttctctccgggctgtttctccaacccgtgtttgaaagcattttccaccaaggtttgcatcatataaggaggcatataggttcgcctcgcatcttcctgaatatctatctttactttcaggcggttaccgaaccggatttgttgaatggaaatatagtgacttgtataagccagttcttcttcgaaagcgacaagcgcatctttttccgtatatttgtaacgcaaaaactttgaaaattcctcaagtgcatgcgttaaatcttttgtccttccaagcctgttcagcgagagcattgcattcaaagagttaaataaaaagtggggctggatttgctgactaagctgtaaatattccactctgtgcagttctttttccatttccatttttttattctccagctgcaaataatccagctccttatccaaaaaaccaagcagcagaagaacaacataagctgcaattggggcgcccagtgacagcataaccagtattgtaaaaatggtttcagccaatggcttcacctctcaataattgttatttctctctcttttaagatcaaattatatcacaaatcaggccaatgattttatctgttttgttgaatagatagaacaagcggatttaaatataataaaggggatgaacaatcattcattttaaaggaggaattacccgtgtctacgttaaattcgtggtgccactactattttccggggaaaatgacagccgcgtcccgttcagtacctgcttttcgtggatggcgggcagagggcgggctgattgactgcggcagcggctttgaaattttcgacgaaataaaaaaaggaatacgccgtccagtctgtttatcttacccattaccatctggaccatattttggaggcgtatctttttaaaagtgccaaaatttaagatgtaaaaaactgaatgagatagaaaaactgacaaaagcgagcggcatgctgagcccggccgacgcggagaaccgcaaaaagtggacaaaacagctgtttgaaaaacgcctgaaaaccggcagccgttgctgaaccatacggaaaaatgatatccgtacggggaaaagtttgatgtaaatggaatgaaatgtcgatgatccatccgcccggccatacggaaggacactgctgcccatatatttccgaagcacgtatccttttgcctgcgattttgacctggcctcttttaacctgtggtacaacaacgccaactcagacatttgaggcatttatcgcatcgcatatgcgaagactatataagttgaatttggaatttacatctttacgcacagtcggttcatgttcgtttcccttcttttcttagtccatccgcatacgttattatcatgccgccctcccatttcaaagccatcagcccttattccttttccagcttctcctttatttcaaggatctttttttcagaaaagcctgttgcctttttgataaaatctagtggcatcccaagtttaatgagatttcgggtgatctcgattttcccttcttgtcttccttctcgtttaccttcttgtagtccttcttttctcccttcttctcttgcttcttgttttagttcatcttcatacgttatcatcatgccgccctcctatttcaaagccatcagaccttattccttttccagcttctcttttatttcaaggacctttttttcagaaaagcctgttgcctttttgataaaatcaagggatgccccaagtttaatgaggtttcgagtgatttctatttttccttcttctcttccttcttttctcccttcttctcttgcttcttgttttagttcatcttcatacgttatcatcgtgccgccctcccaatttttgatttcctggttaaattccttttggtaatgactttcgagttttatcatgtggtccatgaaaatgaaaagtgtcagtaaatcctttttatcgagctgcaagcgatctttcataacattaaaattcattctaccgcttataatctctttcttttcatatttggaattctccattaacttaaccccttaataatttttaagtgtcatttattctaagattttaacttattcatcataacggtccttttttcgtaaaacgttccaaactgttttacaacaatgagaaaaaaataaccaatgccagcaataccgtatttcatatattttctcccgacattctgatccgtaattttttagtttgtttatctatacaagcataacagccacgtgaactactagcccaataataagtaaccaaataaagaacgaaatataatactcataaatgcctcatcctcattataaataaaatgccagcctgctgataaattgtcccatcctactgtattcgcatgggctactgcatatcctattccaacaaaaacgattgagtagagaaaagcagcgattaagaaaaatttcattcgatccattgttaatcggccttcttgaacttctaacttgatttcttcaaagttttctttcgttaagattttttctctctccttcatatcatcctattttttcttcattattaactcttaatttttatttaaaccatttcgctacactgtctcctatacttttgctgactttttcaatcgaatctattcccttgtttattccctttttactttgatcagatatactcttggatgaatttccccacttataatttatcccgtaactaaccattgtcccaactccaaatccaactaccgtgccaatcggaggaaagaatgcggaaccaattgctgtacctgccgcagtagctgccgtgccaaaagcaccgtctacaacagttccaactacaactttttgcgtgtcacccttatactttttgtaattatccgcagctataagtccgtaacctagcgggcctagtgcttttccggctacttttgccccttttcccaatgtattcaggcctttaaaactttcttttatttcttctgtcaaatttttgtatgcaacttttggttttttccactctgggagagatctgacagtttttttaattgctttatatttttttccagcaaattcgtctacaaatgttgttgatattttcacagcttttttaattggagatagtttcttcatctctctaaatttatctattccataaaggttttcaaattctttcttcattgcaagtttcccacgttctctgccaaacgtttcaatagactcaagtaaatgattaaaattttcttttgaaagtgccttccctttgtatttagccagatgatttaaaagagcttttccatttattttatagattgtattattcatataattattaaatgttcgatactcttcctttgtaaaattatggaaaagctcacttttaaatgctttgcgcctccccttatccagtttctaataaatatagaactggatagcagcaatcaacagggtgttagacttattaatgtatttataagtacgttgcattgctttaaagccattgctcattaaaataaatattgctaatttatcgacaaacacttgttgttcatgtagtgacgaatcattatcattcaaacagtcagcttgtccgcccccaaccaaactcctttctcctgcttccatcactttcttcatcaccctgtccacgtcgcggcggctttcttcgacgatttgcagggctttgcggtcaaaggcgtggagtttttcattcacttcattcgcaaatttttgtgatgcttcagcgctttctatgaaatggcccaagtccggtgccggaatggatacaatatcggaaatgctgtgcaaaacttgtaatccttcatggtagatgtccatcatttggtttttcaatatgcgcgttttttgattaaggtcatgcatataatcagcgtgcagtaccgcgcctggcgaatcatccactgtaccctcaaattcggaaatgatttggttgtaccggtgctgaacttgccgggcagctgtcaccagtgcttcaatcatttcaccgtgggtagtgtgaaaataatgttttgctgaatctgccgctttccctttaaaagattgcagcctactgatcgcgtttgttttttgccttacaacttccagccttgccgccatttcttttgtgctccggtcgatttctttttgcagatgcagcagttcttcaaattcaactttcatggtgcaacattcaaccctttcccctctttaattctcaagcctgtgaaaagactggccgatgtgatcatcctgctgtaccatctcattccctaattgttccagtttccgcaagtccgcatcgagaagcgcgctgtacagtttcaacgtgttctgcagtttccccactatttcaagctgttctctcatgctttttaaatccggcggctgctgcagtgttatttttaccggcttaatgccctcaagcgtagacctggtactgtccgcttggctgagcactgcacggaagacggtttgattgatcgcaatttctcccatcacttaatccccttccacaatttcctggctcaagttagaaatatacgactgcaaatatgataaattgctttgtgcctcattcagctggttcgcaaggcgccggatttcttcttccagcctgtcctccgtatttcggagatgatgcacatattggcgtacagacgactctattttatgcaagtgattcaaatacttatttttcgttgtgcctttccaagagggtggatgaaaatcaatatgcgccaccttcctttcgtgctgccatgcgccttcaatgactccctccattcgcccctttgcccgatacagccgctcgattttttcttcaagcagtgcagcatcctgcctcgctgctgctgcctgagcctgcatgttttcccttttgcggatcagatcgcttttatccatccttcgctcaccgcctccccttgttcgagtgtacaaacggtttattttaccactattttctatcaaccagcttctcgttttaatattttttcaaaaattaggtcttttgagctaacttggttacttatttccctttctccactaactaaaaccaggatattcagatggtggcggcaatcatcatccccatgagataccaataagaggaaaggcggacaaaagaagagaatacttggtggcaaatttttgcataaagagctttttggtggactatcggaaaactttattcataaaaaaatccggacatcaaaaagtgcccggaatttttatgattttagtcaaaaataatatggtttactgttttgcggtcgagacgtttgatcacttctgttattagtttaacagtattttcgtaatcatcacggtgcaagatgccggcgtgcgagtggatatagcgtgttgcaatcgtgatggcaagagatggaatgccgctgcccgttaagtgaatggagccggcgtctgttccgccgcccggaatcgattcaaactggtacgggatatttaactcttcagcaactttcacaaccgtatcgcgcaagcctttatgcgccaccattgaagcgtcgtaaatcacgatttgcggacctttgcccattttgctgagtgcttctttctcggagattcctggggtgtccccggcaatcccgacatcaagtgcaaaggcaatatccggtttcactttgctggctgccgtcttcgcgccgcgcaagcccacttcttcctggacatttgttacaccgtaaacgatgttcggatggttttctttatgcagattttttagcacatcaatgacaactgcacagccgatccggttatcccaggctttggcaagcagcattttttcatttttcataaccgtaaattcaaagtaaggcaccaccatgtcgcccggttttacgccccattcaagcgcttcttcccggcttgtggcaccaatatcaatgaacatatccttgatttcgtacgattttttgcgtgcatccggtgataaaatatgtggtggcttcgatccgatcacacctgtcacatcacctttatctgttacaaccgtaacgcgttgggcaagcatcacctgtgaccaccagccgccgatcgtttggaagcgcagaaagcccgactcatcaatttgtgtcaccatgaaaccaacttcatccatatggccggcgatcataattttcgggccgtccgcctgccccgttttctttgcaattaagctgccgaggccgtctgtgtcaagttcatcggcatacggctctatgtattttttgacaacggcacgcacttctgcttcattgccggcaatcccttttgcatcggttaaatctttcaacatggacaatgtctcatctaactttgccactggcatttcctcctcgtcccgatatgtacaaagcctattataatcaaaatcgcaaaaagtgtaaaaagtttcagccttctattttatatcacgtcggactatgccgggtatttcctgatactctttttatatgtcagaagcagcatgctttagagagcttcatccaaccaagaagagctggaaatagctgcttcactgcctgatgggaagaaggtagactacctgttttctgaagcagatggtgtattcattcggggactgaaaaagaaacagagtatggaagtccaccacgccattctctatgagggatgggaaaccaatggaaaaagggtctccctgcgtcagcccacagtcatcatgacgacggaagccattcagacattttgggatgaagtccaagccacagctgccaacacctattccctcgaaaaagcgcatgtcattacaaacagtgatggaggtacgccgagatacggcaaatcttcccgtccgttttttgaagatgactgttatgaaaaaaatcagcaaaaacaaaaataatcaaaataaccacaaggtctcctgctttaaaaacaaggaaacccgccggaaaatctttggcgggtttccttaaactttacagatttgccgcgacttcgtaagcatcccagatggcatacatgatgtttgcgaccttgcgggcatcgccaaccacatgaagatcggcaacctcaaactttaaatcttcatagagtgatttttcagccgagtagccgactgcgagcacaatgctgtctgcttcaatttcacgcaattcgccgtcaacatccacaacggctgtcttttctgtcgtatctactatttttgaagaagtgtagacttgaacacctttaaacggtacgagtctttccagcatgtccgagttagcgtggcaaagcggaccattaactgccagcagtttgtcctgcatttccacaagcgagacatcttttcctttttctgcaaggttcaaagccagttcgcagccgacaagaccgccgccgacaatgacaacatgttgcccggcatccactttatcgagcaaaacatcttctgctgtaaatactttgttttttccgtcgagcggcaaaattttcggattcgaacccgttgcaatcagcacggcatccacgtttgcagccaaaatttcttcttttgtcaatgcagtattcaaatgaatttctacgccaaggcgttccaacgtatgctcataccaggcaacaagcgccaggtcatcttctttaaaatcaggtgcgccgccagggatcaagttgccgcctaaacggttcgatttttcaaaaatgaccggttcatggccgcgcaatgcaagcacacgggcagcttcgcatccggccacgccgccgcctgcaatcagtacgcgtttcttttttaaagcaggtgtcaatgctgcttctttttctcgacaggcagccggattcactgcgcagcctaaggaagaatactcctggatccgacccatgcagccttcatggcatgacagacacgggcggatatcggcaacctgcccggttcggagcttattgacgtaatccgggtcagccaataacgggcggcccaagctgataatatcacatgctccgtcttccagtgcggcaagtgcaagatccggattgtccatgcggcccgcgcaaaggacaggcacatcgacagcttccttcaccagcctggcatacggaatgtaaagccccttcttctggtacatcggaggatggctccaccaccatgaatcataagaaccaacatcgacgtccagagcatcatagccgtaggaaacgagcagctttgctgcctcgatgccttcatccaaatcgcggcctttttcttcaaactcctcgccaggcagtgccccttcccgccaatccttgataaaacttttcgggctgaagcggagcgtcacaggaaaatcttcgccacagcgctgtttaatttcctcgacaatttcccgggcaaaacgaaggcgattttcaagcgggccaccgtatgcatcggtacgtttgttgaaaaacgcaatcgcaaactggtcgagcaaatagccttcgtgcacagcatggatttgcaccccgtcaaatccggcgcgcttcgcattgaacgccccatccccgaatttgcggacaatggaatgaatttcttcaactgtcagttcgcgacatgttttatccagccagcgatgcgggattggcgacggtgcaaccggcgggtactcgccaaggtttgtcgggatcgtcacccggccaaaaccggcgctcatttgcagaaaaattttcgaatcatatgaatggatgcgctctgtcatttctttggaagtccggacaaaatggacagggttatgggtcgggcaaggtacgtttggcattccgtgctcttccacttcattatcaacgaaagtgacgccggtaataatcagagcggttcccccgcgcgcacgggctgtataatactcaatcccgcgctggttgaaaccgccttctgcatcggcaagacccagcggacccattggtgccattgcataacgatttttgagttccacattccttattttcacagtttcaaatagctttttgtatttcattttaaaggcctccccggattttccattttcatcgaatggattcggtgaacattttcattatagaatgggtataataaaaaatcggtagacaaaatgtgaaatttttcacatatgtagaggaagcattgacaaaggccgcggcttgctttcataattttttacatatcatgaagaatcggggaatgaaagatggatgaaaagccgttgaccaaaaggaaaaaacaggcgatggaaacgaaaaaccggattttcgaaacagcgatggagctgtttgccaaaaaaggatacaaagacattaaaattgaagatatttgccggctggccggcgtttcagtcggtgctttttatcattattttccctcgaaaaatgacttacttcttgaaatgtacagccgggcagatgtgtattttgcagaacaagtgcgcgaacgtctcaaacacctcgattttccacacaagatcacagccttttttgccatttatgcacaatacaatgaaaaaacaggaatcagtatgatgaagcagctttaccatgcagaaaaccgcctgtttatccaaaaggggcgcggcatgcaggagacacttgcacaaatcattgcagacggccagacagcaggagaaatggttcgtgatatgcctgcagaaaaaatcacggagtacctcttcattgcagcacggggcgtcacgtatgactggtgcttgcatgatgggggttatgatttggaaaaggcaatgagagcgtatatgggaagattgttaaaagtatttttttaatagacaaaatagttcaaattcattataataaagaaaaatgaatgatcattcattttaaagggggccttacccatggcatatacgaaattcgggccgcttaccgtcattacgggggaaaacggcagccgcgttccgttcagtacctcgcttctcgtcgagggcgggcagggggcggcgctggttgactgcggcagcggctttcaaattttaaatgaaataaaaaaggaatacgccattcggtctgtttatttgacccattaccatctggaccatatttggggcgcgtacctgtttaaagacgccgaaattcaaatcaatccatatgatgtaaaaaaactgaatgatgttgaagagctggcaaaagcgagcggtatgctgagcccggccgacccggagagccgcaaaaagtggatgaagcagctgtttgagaaaccgcctgaaaactgggaccgcccgcactggcagccggtgctgaaccttacggaaaaatggtatccgtacggggaagagctcaatgtatatgggacgaaaatgttgatgatccatgcgcccggccatacggaaggatactgctgcccgtattttccggaacacggtgtcctgtttgccggcgattttgacctggcctctttcggaccgtggtacaacaacgccgactctgacattgacgcctttatcgcatccgcgaaaaccacgttggaaacagatgcgcaaattttcatcacttcacaccataaaggggtggtggacagaaaaacatatgaagaattgctgaagcggtatatcaacaaaatttacgagcgcgaagaaaaaacgcggtctgctgtaaagcggggtgtggcgccggacgaaatgatctacgaagaaattttttattttcggaaaaatctagaacagaacccgcaacttgtgatttccgaaatcgtcggcatcgccaagcacctcgacaggcttgtgcgtaatggggaaccgtttgaagcttattttgaagcatttttgcagcactttcagttaacaagggaaaatattttctatcacacatcttctgtcccgacacaactccaataacaagtagcggcgcccgcttcgccgctatttttcctgtaaaagcctttttatgtgccggacacagcgcttgcacaaaaaaaacaaccgccattacggttgcaaatcggcagcttgtttcctcagctgcgtttttaaaattttcccgaccccgttgcgcggcaggtcatctagaaagacaaattttttcggcactttgtttttcgcgagatgcttgaggcaatacgcggccaaatcctgcgctgacgtttcgtctcccggcttcttcacgataaaagcgagcacttcttcccccatccgctcatccggcacaccgatcactgccgtttccagcacagcggggtggcgggcaagcagttcttcgatatcacgcgggtaaatattaaaaccgccacgaatgattaaatcttttttacggtcgacgatatacaaatatccgtcttcatccactttcgcaagatcccctgtataaagccagccgttctttaaaacccgcgctgtttcttctctattttggtaatagccaggggtgatgttatcgccgcggaccaccagctccccgacctcgccagccggcacttccaaatcattcgggtccacaattttaatctcaacgccagggatcggcacaccgacagaccctggtttatacggcataccctcctcgtataataagtttaaatccaaagtggatgtcaatttccagttcattctgctgctcattgacaagttttttgtctttcataagctcgatgaaggacatttctttcgtcccaactccccgttttgtctttcatgaaccctatgaaggacatttctttcacctcggctcctcgttttgtctttcataagcccgtgaagaacatttctctggttaccgatccctgttttgtccttcatgtccctcaccccgttccgcgtttttgtcagccagacgcaaaacggatagcctcatttttcccgtacaaccaaaaaactgcccggtgaaaaccgggcagtctgcagcagaatggcattattttttcaagttgtagaaagttttcttgccaaggaactcggctgtttcagccaattcgtcttcgatgcggagcaattggttgtattttgctacgcggtcggtacgggatggcgcacctgttttgatttggccggcgtttgttgcaacggcaatatctgcaatggtgctgtcttctgtttcgccagaacggtgggaaacaattgcagtatagcctgcacgttttgccatttcaattgcattgaaagtttccgtcaaagtaccgatttggtttactttgatcagaatggagttgctgatgccttcttcaataccgcgggcaagtttttcagtattggttacgaacaggtcgtcgcccaccaattggactttcttgccaaggcgttctgttaacattttgaagccttcccagtcattttcatccaaaccgtcttcaatcgaaatgattgggtacttcgaaattaattcttcataccaattcaccatttcttccgcactcaggactttgccttcgccggctaaatggtatttatggtcttcgtcactgtaaagttcggaagatgcaacgtccattgcaagcaaaacttgttcgcctggtttgtagccggctttttcgatggcttcaataatggtagaaagggcttcttcattcgatttcaagtttggtgcaaaaccgccttcgtcaccgacagcagtattataacctttcgcttttaaaacagaacgcaggttgtggaaaatttcagcacccatgcgcaacgcttctttgaaagtcggagcgccggcaggcatgatcatgaattcctgaatgtccacgttgttgtcagcatgcgcaccgccgtttaagatgttcatcatcggaaccggcagttgttttgcgttgaatccgccaaggtatttgtacaaaggcaaatccaattcgtttgctgcagcacgggcaacagcaagggaaacgccaaggatggcatttgcgccaagtttgcctttgttcggtgtgccgtcaagttcgatcattgctttatcaacgccgacttggtcaaatacatcgtaacggccgataatcgcttcagcgatcgtgtcgttcacatttttaacagctgtttcgacacctttaccgaggaaacggcttttgtcgttgtcacggagttcaacggcttcgtattcacctgtagaggcaccgcttggcaccaatgcgcggccaaaaccgccgtcttctgtgtaaacttctacttcaacagttgggttgccgcgcgagtccaatacttcgcgtgcataaacatcagatattaaagacatcttcttatctctcctttttcaatgcataaatggggttttcatcactttgcccggcactttccaggcatggcgctaagggcacgtctgcgggaaattttcccggcatgcccccgggtgtcatccctttccatgccgcagcaccttccaggcatggcgctcccgtttttagggcgtcactttcaacgcatttggcccgattttccttttatcaggcttccccacacagggtcattttttaatcaggcttgtgcctgtcatttctttcggtttttcaatgttcagcagatcaagcatggtcggtgccaagtcggcaagaataccgccgtcacgcacttcaacgccttttttcgtgatgatgaccggaaccgggtttgtcgtatgggctgtcatcggtttgccttccggtgtcagcacttcatccgagttaccgtggtccgccgtgataatggcatagccgcctttttcaaggatcaggtccacgactttgccgaggcattcatcgactgcttcgatcgctttaatggttggttccagcatgccggagtggccgaccatatccgggtttgcaaagttcaaaatgatggcatcttgtttgtcattccgaatttgctccagcaaagcatccgttacttcataggcgctcatttccggttgcaagtcatatgttgctactttaggggagtgaattaaaattctttcttcccctggaaaaggttcttcacgcccgccgttcataaagaacgttacatgcggatatttttcagtttctgcaatccgcagctgttttaacccgtgctgtgacaatacttcgccgattgtattgtcaaggccgaccggtttgaaggcaacatagcctttgaccgtttccgaaaaatgtgtcatgcagacgaagtacaaatctttcgggtgattcgggccgcggtcaaatgcgcggtaatcttcgttcgtaaaagcatttgaaatttggatggcacggtcaggacggaagttatagaaaatgaccgagtcatgatcctgaaccgttgcaaccggtgatccgtcttcttttgtaatcacagaaggaataacgaattcatcaaagatgccatttttataggaatcttcaatgaccgccattgggtccggatatttcggaccttcgccgtatgccatggcgcggtacgctttttccacacggtcccagcgtttgtcacggtccatggaatagtaacggccggtaatcgttgcaaattcgccgacaccgtattctttaaatttttcttctgttgctttgatgtatttttccgctgttttcgggcctacatcacgtccgtcaaggaaagcatggacgtacacttttttcacaccttgatcggctgcgaatttcagcagcgcgaacatatggcggatatggctgtgcacgccgccgtccgacaacaagccgaataagtggaggcttgtcccgtgttttttcacgttttcaaccgcgccgaggaaggtttcgttcttttcaaactcgccttcgcggatcgacatgtctacgcgcgtcaaattttggtaaacgatacgccctgcaccgatgtttgtatggccgacttccgagttccccatctggccgtcaggaaggccgacggattcgccgcttgcgccgagttgattgtgcgggaattccttccagtagcggtcaaaatttggtttttttgcttgggctacagcattgccgtatgtttctttccggcagccgaagccgtctaaaatgattaatgccacaggtgctttactcatggcttaccgcctccaataattgcaaataagattgtgggtcaaggcttgcaccgcccactaatgcgccgtcaatatccggttgttccataaattctttaatgttgccgggttttacactgccgccgtattgaattcgaacgctgtcagcaacattccggctgaattggtccgcgatcacactgcggatataggcacaaacttcgttggcatcttcggcagtcgaagatttgcctgttccgattgcccagatgggttcataggcaacgacaacctgttttgcctcgtcgtcagaaagcccggcaaaagcagcttttacttgcgatccgacgatttgttttgtttcattgttttcccgttgtgccagtgtttctcccacgcaaacgattggtgttaaatgatgggcaaaagcagcttttactttcttattgactgcttcatccgtttcattaaacatttcacggcgttcagagtgtcccaggatgacatattcaacatgcaaatcagcgagtgcaaccgggctgatctcgcctgtaaaagcaccactttcttcatagtgcatgttttgggcgccaatttttacgcgggtgcctttcgttgcttccaccaggcgttccaaaaagagcgcaggcgcacatatgacgctgtcgacaacagattcgccaggtaccgaatgttttacctcttcggtaaaagccagcgcttccggcaaggttttattcattttccagttccccgcaatgatcggtttacgcaataaggacactccctttcctgataaaattatttgtcatttaaagctgcgacgccaggaagtgtttttccttccatgaattcaagcgatgcgccgccgcctgttgaaatatggtccattttctctgccagatggaatttttcaacagctgccgcagagtcgccgccgccgatgatgctgtaagtgccggttgcatccgcgagcgcttctgcaacgccttttgtcccgtttgcataggcgtccatttcgaatacgcccatcggtccgttccaaatgacaagtttcgattctttgatgactttggcatacagttcaaccgttttcgggccaatatcaagtgcctgccagtcagccgggatttcttcaatcgctacctcttttttgttggcagtttcggagaattcgtctgctacgatcgcatcaaccggcatatagaagttgacgcctttttctttcgcctttgccataaaagattttgcaaggtcaattttgtcttcttcaagcagcgatttgccgatttcatggccttgtgctttgacgaacgtataagcaaggccgccgccgatgatcaggttgtcgactttatccagcaaattgtcgatgacgccgattttgtcttttacttttgcgccgccgataatggcagtaaaagggcgttccggattggacaatgctttgccgagcacatccagttctttttgcattaaaaagccggatactgcaggcaggtgatgggcaatcccttctgttgatgcatgggcacggtgggcagcgccgaatgcgtcgtttacatacagttcagctaaagatgcaaattcctttgccaattccgggtcatttttttcttcacccggatagaaacggacgttttcaagtaacaatacgtcaccattattcattttgctgatttccgccttaaccgattcgccataagcttcatttgcttttttgacgtcttttccaagcagttcgctcaggcgttttgcaaccggtgtgaggcgcaactcttccacaacctggcccttaggacggccgaggtggctggcaagaatgactttcgcaccgttttccaccaaatatttgatcgttggaagggcagcacggattcttgtatcatccgttacattgccgtcttttaacggaacattgaagtcgacacggcagaaaacgcgtttgccttgcaattcaacatctttaatcgattttttgttcatggcaaaacgaacctccttttgttttacaggcattgaaaaaagggagaggggattcttccccacccccctgcaacgttttatcgttcaaattaaaggcctttagaagcgatgtattcaacaaggtcaacaacgcggttggaataaccgaattcgttgtcataccaagaaatgacttttaccatgttgccttcgataaccattgtggataatgcatcaatggtcgaagaaacagttgtatggttgtagtcacgggatacaagcggttcttcgctgtatgcgagaatgcctttcaattcgccttcagccgcttctttaaatgctgcgtttacttcttcaaccgttacgtttttgccaagttcagcaacaaggtcaacaacagaaacgtttggagtcggaacgcgcatggccataccgttcaatttgcctttcagttcaggcaatacaagtgcaactgctttagcagcaccggttgtagtcgggatgatgctttgtgcagctgcacgtgcacggcggtagtctttgtgcggcaagtcaagaatttgctggtcgtttgtgtaagagtgaacagttgtcatcataccacgtttgatttcgaatttttcttgcagcacttttgcaaacggcgccaggcagtttgttgtgcaggatgcgttcgaaatgacgttatggtttttaggatcgtatttgtcttcgttaacacccattacgatcgtaatatcttcgtttttcgcaggagcggaaatgacgactttctttgcgcctgcttcaaggtgttttgcagccccttcacggtttgtaaaacgacctgttgattcaacaacaacgtcaacaccgaggtcgccccatccgagatttgcaggttcgcgttcagccaaaacttttactttatggccgtctacaacgatggaatcaccgtctacagtgacttcttcttccaggttgccatgaacagagtcatattttaacaagtgtgcaagcatttttgcgtctgtcaggtcattgattgcaacgatttcaacattaggattgcctaaagcagcacggaatacgttacgtccgatacgtccaaatccgttaataccaactttaactgccatttgtgtttcctccttgagtcgtaaagattttatatttcaaaagggttatcccttttaaaaacaggttagcgccaagcgagaatttgttttgctgccccttcgtccgtaatcagaacagtggattccggtttcgtgttcatgtaggctttaatggcctttgccttggatgccccgccggcaaccgcaaaaacatggcggatccggtgcaaatcctcgagttgcaggccgatcgtccggaccttgtgaacaatttcaccctgttcgttaaaatagtacccgaacgcttcgccgactgcatgcccacggatgattttctccatctcttcttttccggtcttgcggcgttctgccattgtcatggcttcgccaatgccgtgcagcacaatatccgcttgtttaataagggtaaggacttctttaatggacggctcgtttacgaccgatttgtacacttccgggctgacctggtcaggcacgtataataccctgtgttttccgccggtcctttccgccatttttgcgcagatcgtgttggcctgatttgcgacatcttcaccaattccgcctctggccggcacgaacagcagctgcctcttggcactgatgtcgggagttaacacatctgcgactgcggccatcgtcgatcctccggttacagcgattatattgtttcccgttaaggcggctttcattcttacagcacaagcccttccaagctcgtttttcacccacggttctttgtcgctgtccccttgaaccacgaccacgtcttcgaggcccaaagcttgtttcagcttttcttccgtttcatttatacccgatatttctctcatcatgctttccatattttgtaacaaggcagcaccatcatttgtcaccgacatgcccgagggttttacgtcaatgagcttttggtttttcaaaaaatccgtttcgctccgaagaatgcgttctgacatgccaagcatttgtgccaatgttcttcttcccaccggttccgcaaaagaaatggaacggagaatccggtatcgtttttgcatgacagcgaggatatcggggtataattttttttgaacctctatcaacgatcgcatagataatgtactcccttaaataattatgtaggtcgtgttgagtcccacagagacattttttgtcccacctgcttcaaaaaaaattaccctcgctacatgtttcattctagcaggataaattttgcatttcaactattattgctcatgaatttcatgtaagcgctcctttatggcaaaaaggtgaatccgcccatatccgagcagttcccctttgtactcgataaccgggatcataaggccgtatttttccgtccatgcatcgcacgcttcgatgtctttttcaatcagccggaacgggatttccttttgcaggagttgcagctgttcttttgcttccgcacaaagcgggcattgttttcttgtatatagcaccagttccattttaaaatcctccccctttccggccattcgtggcaggcacatgggctgtgctcccgacccgatatacccaaatgcctgatccgttatttatttatttcaaagtgtgtgcgaaatttgcccgttcccgtccgattcgtccttttttgccggcggatgaaacgcgaaacttccgttttgaaaaaatattcccggcttattcgtacctttttcttttggaagatgacggaatgccgagctgttcgcggtatttcgccactgtccggcgcgagatttcaaaccctttttcatttaatacggtcacaatcgcctggtcggaaagcggcttccgcttgtcttccccgcttataagtgctgaaatttcatttttgacctcggcgcttgatgctgcttcttccccgccggcagaacgaaccggcaaggcggtcgtgaaaaatgtttttaatgggaaagtcccgaatggcgtttccatatacttttctctcactgcacggctcaccgtcgactcgtgcatcccgatgtcatccgaaatttctttcatcgtaagcggcttcaaatgcccttttccatataaaaagaaatcccgctgtttttcaagcagtgctgcgccgacttttagcagcgtttctttccggctttcgatgctttttcggatccagtaatattcctgcgttttttcttttaaataacgggtgacgccggcatctccggccgggttcatgcttgcataactttcattcaaacggagttttggaacctggttttctacaagatacaattcgagctttcccgcatgatttttgaccaaaagatcgggaacgatgtattgcggccgatctgccataaaaccggatccaggacgcgggtttaacgtctgcacataatcagatacccgctggatttcctgcagggatatatcaagttttttcgcaatgcctctccattttttttcggcaaaatcgagaaaatggcggctgatcaattcttccgcatgcccgggcgcatccggatccctttttatctggatcagtagacattcctgaagcgatcttgcgccgattccggccggatccagcgactggagaatgccaagtgctttttcggcgtcttcttcggaaatggcagccatttttgccgcttcctgaaccgagatggcaaggtagccgtttgcatccagatggcgcgcataaagttggaccgctttcaaaatcttgtttgataacgctttcatatccaattggctgatcaaaaagtctggaagtgtttccgtctgtgcaggaatttgttcaatccagtttttgtcctggctttttttctgcccctttacacggctcagcccggaaaaacgggaatcgaccagtttaatattggcgctggacagttcgatgagaggattttccgcagctttttcttccaaaaaagatgcgagctcctgggatgagaactgaagaacctcgattgcttgttttaattcctgggtcattgccagtttcattgactgcttttgccacaatccgacttgaagatccataacattccccccttggcaatgataaaaggcttctcttgctattgtcttttattttacaacatttttgtgttttagtatatgcaatggcaagaagtcccatgcttccggggatatgggcagccggcaaacgcagacgccatttttttttgccggaaaatttgcgcacataaatggcgttgcggtgccgcaacgccatttgcttaattttcttcttcaaaatcgaatttccggtcggtccggcagttttcacagacataaagcactcttcttgattccgcttcgttttcttccggtgtttgggaaccgcagatttcgcatactttcaagtgccttcctccttttatggttccatcatttcagcacggtaaccctgctccgtcacggcttgcatcatatcgtggcaggatgccgattggtcattataggtaaaagtcgcttcttttcttgccaaactgatttcaatatcgcggacgccccagacttcattcagggcgcggcggactttggcggcatcttcttcattcaccatatcacttactttcaacatccctttagccaatgtccgttcctccttcaggaagcgaatggttttgctccatggcttcccccatccccgccaaaatgcctgtcatcatggcaagcgaccgtttcacttccggggagcgcatgctttttccgagcttccacagactctcctggcccccggattgggctgctttttcaaacccgctcgtgatgcctgacaagatcgtttgcagttgttccggatcgatggcgcctaaaaatttaaatacgttcatcccgtttttgacgacatggtacatggtgggctggtttagttgccctaaggcaatttcggcaacgtcaacgcggttttggagcaaaccttccatcgcattaagcacgcccatgccatccagctgtttgatgatctctaacagtttaatcagtgattccccgttttcggcggctgcctttacaaccgccgacagagaggctgcctgccattcttccggggccggatccacttgtttaatttgcctgatcgccttcgccatatgctttccctcccggctttattaatttcacggccggaacagagccttcccgtccgcggatttctttctcattaccggcccgtcccgtttgcctgatcaccttcgccatatgcttttcctcccggtgaaaataatgccgtgatcgggataaagtcatcccgcttccatttttcttccactcttacactgatttgcggaatccgattgccataacggtggttcacctttggcagcggcggttttcctttttcctctaaaatctccatttttacgcccatttctttatagttcggggtatgggtcaccctgtcatgatagctgctcgtcagccggttcaccatttcatcctctttccgggcgttcatcgttaagtacaattcttttccttgtacccgcccggtcacaacggcccgtactttcacctttccgtaaggcgatgtcagccgtacaagcgccccgtcttttatcccccgttcacttgctgcctccggtgaaatctcaagccacggctccggcactttgtgatggatgcccggagaacggtccgtcaaattcccttcatggaactgttccagcaagcggccgttgttaagatggtaatcaaatccctccccggctgaaaaaggcggttcccagtcaaccggtaccagtcgggctttaccgtccggaaaggcaaaacggtcttgatatagaagcggtgtgctcgtaccgtcttttttaaccggccatatttggctgttaaacccttccagtctctcgtagctgatgcctgcaaagtactttgctaggcttgccgcttctgccatgatttcgccggggtgctggtaatgccactgggctcccattttgttcgcgagctcctgaaagatgacccaatccggcttcgattcacccatcggttcaaatacctggtaaaagcgctggatgcgccgttccgtatttgtaaacgtcccttctttctcaaggctcggcgcagccggcaggatcacatcggcaaattgggccgttttgctgaaaaacacatcctgtacaacaaaaaagtcgagcttttccagatgttcttccacaaaattaatattggaatcaacgatcgccatttcttcaccgaacaggtagaggccccggagcttgccgctttttatcccgccgatcatttgatgattgtcaagccccgggttttccggaagtttgaccccccaagccttttcgtaccgttccctcacttcattatcttctactggttcgtagcccgggaaccaagcgggcatcgttccaaaatcacaggcgccttgcacattgttgtgccctctgagcggatatgcccccgtcccagggcggccgtaattaccggtaaccaataacaagttggaaatggccgtgcttgcatccgtcccgcatgtgtgctgggtgatgcccatcgcccaaagaatgcatacggatttggcttcatggatcatcgttgccattttgattaagttctctttcgaaatgccggttttctcctcggcaaacgccagcgtgtatttttccagtgaagctctgaacttgtctagccctttgaccctggcttcaagaaatgctttgtcttcccagccctgatcgagaatgtattttgtcacggcgttaagccaaatcaaatctgtgcttggcttcgaatgaataaataaattggcgcggctggccagttcgttttcccttaaatcgacgaccataagcttttgtccatgcaatttgtgcgcccgtttaatgcgtgtcgcaaggacaggatgggattcggccgggttcgcccccaccgtaaccaccaaatccgcctgctggatatcccggatggtgccggagtccccgccaataccaacggtccgcaaaagccctgacgttgccggcgactggcagtaacgcgagcaattatccagattatttgtaccgatgatcgcgcgggcgaatttttgaaagagatagttttcttcattcgaacatttagatgaagcaataaagccaagcgcgtccggcccgtgctgttcttttatttcctgcaatttgcttgcgatcagattcagggcttcatcccagcttgcttcaacaaattcttcccctttgcggatcaacggctttgttaaacgttcttcgctgttgacgaagtcccacccgaactttcctttgacacatgtcgagatgccgtttactggcgcatgttcctgcggctcgacttttaaaatgtggcgcccttttgtccaaatttcaaaactgcagccgacaccgcaataggtgcaaacggttttcgttcttttgattctcgattttcgcattgccgcttccatttcggatattgcaaaaatctctttatatcccggttcgacttctttagtgagatcgatcatcggctccagcactttttgcggaatgccggttaaataccctgcttccccgagcatggacttttccataagcgcattgcacgggcagaccgtgacgcaatggccgcaagatacacaagaggactcatcgatgggaacatcattgtcccagatcactcttggcacttcccggtcccagtcaatcgtcaatgtttcattgacttgcaaatcctggcaggcctcaacacatcttccgcaaagaatgcactggtccggttcatagcggtaaaaaggatgggattggtccggcgggtagggtttagcttcaaactggtatttttgatgctcgatttcaagatgctcggccgtgttatggacaacacaattgccattattgttgtcacacacggtgcaataaagctcgtggtttttcagaatccgtgacattgcttcatattgggcatcttttacaggtttggaaccggactccacttccattcccggctctaccttggttgcacatgcccgcaccagattcccgtttacgttcacaaaacaggtatcacaagtttgaatcgatccgagattcggatggtaacagatcgcggggatgtacatatcgtgggcgttggccacttccaaaatcgtttgccctttacgcgccgccagttcttgcccgtttattcgaatcgaaaaggttgcttcttccatcatcggtcccccaatcatgccttttttattaggattgccaattgactttcttctataactgatttgggattgtttctttaccattttgcgtataataaaagtagatttttttaaaaaggggatcaaaccatggaacaagcggaattgtttgaacgaatcaaaaacatgattatctcatccacaaaagaaccgaaatatactgcactgtctactgtcaagcttgccgatctatttgacacggaccctcgtgaaatagagagggtcatcggggaattggttgaaaaaggaaaactgaagaaatccaaacttgaggaaccgccgcacgcggaaatctattccttgccttgacttgtcccgctccctgcatccggcaaagcggtttcgaaaaaatgaaaaaacatgggtgtaagcttgcataagccggctttggatgctacctttaagaaagggaaagctgcaaacggtttaaatggccggagcattttgtgtgggggaggggaatctatgaacgggtttatgaaaaaacaatatttacctatgataatcgttgccatcgccttgggcattatgatggccccatttgttttaaacttgattgcctatcttgctttgcgataaattttattggtagtttctgttaaaaaagcgggaatttttcagattcccgctgcattgtggagtttttcagccgcggccgcgaccccggcgctggctgtttcaatttcttttacagtattgacgagttctgctatatggccttggacggttaaagcagtttgtttgctttgtttgaccgtggcggtaatttgctggaacgattgccctgcctcttccgcgctgcccaatccggagtgaatggcgctgtcaacttggattaaagaatttttaacatccaaattgtattgccctgaggcggataacatcgattggatctgccctgccagctttttcgtctcctctgataacttccggatttcttgagagacaatcgaaaatcctctaccatactctccggcccgtgctgcctcgatggctgagtttaacgcgagcaggttggtctggtcagcgatctctttcacagacagcaccacatcttcaatctggcgggaagagtcgctcagattctcgatcgtttccatcatttcttttgtacgggtggcaatcattttgacatcgcggatcaggatgcccagctttttttgcccctctgctgccgatgactcggcatagcttgcttcccggctgctctcaatagccatttcatccgttttttgcagattgaaacctaaagattctaccgaagcttggatttcctctgccagcgcaaccaaaccttcactgatttgtaccatttgttctttcaaatcgtgctgcccgttttgatactgctcattcagtctcctgatcgtctcattttcgtaagcttcaagaacgatttgttgttcaaaactcaatattttgctgatggcagccgagatgatccggacttcttctttcctgccgatttcttgaaaaaggatatcgttcaagacattttgaatattttggaaagaaccgatataccagccgtgttcaaggccgatccggtaatgcgtgcttgcaatctgcaagcgtttttcgacaaaatttttgttgatgttgccttgaaacatttcaataagatggacccttaacgttttttggagccgctcaaccgtactgtgtttttcaatgatatccctcagctcctgcacttgcaaaatcgcatcataaaaggccttgacaattttgtcaatatatttttgtacaaggggttgtgcactttttatgatttttaaatcttcttctgtcaggtgaatcaatttcaatcgttccggaatgccaggttgatcgagatcgatggaaacctccattttttctgcattttccaatacgctgctgtgtttatctgatttcaacttataatacagacccattctgccttccctcctatcgatgccagtcaaaaatgaacatcagatacgccccacctatgtctttagacctattatacaataatttttccttatttctatcttttcaataaaagaatcgttcccctttttctgttgaagcattgtatgagtgagcggggtgaggaggaatggcacaagttctgaaagggaggggcttatgtataagcccctccctgttttttcggtgatggtgaaaagcatttacggctcctgcccttctacctgccttttgattttcatgatctcatcttcactcaagccggatgcttgggcaatgagtttcacatccacttgattttttaacaaattgacaataaatcttcttaacctttcttcaccttcttctttccccttcttatacccgcggtcaaagtaagaattcggcaagtctaagaaaacttcttttccatccacaccgggaaatttgacttccatcttatgaatactccagtcgctgttttattttttccacttctgtctggcttaggccggtcatctcaactatcaattgtgggtccaggccattcttaagcatcctaaccacaattgtttgtaataattcctttctccccttttctactccttcttctaatcctttttatacccgcgttcaaaataggagttcggcaattttaatacttgctctgcttcgtcatagctcaggttcaaggcttttccccttctatctgccttttgattttcatgatctcgtcttcactcaagccggttacttctgcaatgagcttcaaatctaattgcttttttaacaaattagaaataaatctttttcttaatctttcttcaccttcttccaatcctttcttatacccgcggtcaaaataggaattcggcaatttcaatacttgctctgcttcgtcataactcgggttcaaggcttttccccttctatctgccttttgattttcatgatctcgtcttcactcaagccagatgcctgggcaatgaccttcacatccacttgattttttaacaagttgacaataaatcttcttaatctttcttcaccttcttctcttccttcctctttccccttcttatacccgcgatcaaagtaagaattcggcaatttcaatacttgctccgcctcgtccgggtccagcattttaatgttttccattacttccgcctcctctttttcgttcaattttaaataataatcaaagaaaccgtatagcagcctcatttttgcagggtcgagttccatccgggccagcatccgcagaaactccagtttgacctgcacccgttctttttctgtataccccattttgcttaataatgccgcggcaacagggttgttgctccggatataatttctccaattttgcttcatcagatgaatggataaatagtgaaaacgaagaatttcaatgttgtggaacgcaaaggtgtatgtatcaggggtttctgttttctcctcataactgaagacggcaatcggcaataccggtttccggtgccggagactgatcatcatgtagtaacgaaacatgcgttcaggaaaaggtttctcgtaatacgactgcggctctacatggatgagaatcacggtgtctttcccttttaccttcgtttcagcaaggatgtcaacccgtttttgctcaccgcccggaaaatccgtaaactgttcctgcgacaaaaaccgcacccgacggtagtcgagatccgctgaaagatccgggaaaaacgcctccataaactcctgaaaaaagttttggatcagctccttaaacaaacgatcatgcacgtgataaccggcatgtttttccattaccaattccaatggcagcactccttttcttatttttcagttttattttataggacaaaagtccgtttttcaagtacttttcactctcgcaagctgccgagtttaacggcaaacaggggaaaaacatgcagtccccgcaatcctttttaaaagcaatcaatcattaaagccgaaatgtctcaccttgatggaagacatttcggctttataagtgtgtactgtttattgaccaagaatccctttcagctgctttttaatcttatctgtcgcacctttccaaaatccttggttatcctcaatttttttctgcaatttatcggcttgttcttttatcgcttcatcgatgttttgcagtttttcttttaacgggttaccgttttccttctggtcattgatggattccaccccgaagtcacccggttttgtatatttcagtgtggcattcatcacaccattgaaaaccggcacaatgccctgttcactcagaccgtataaataatggttccggtctgtctggtcatatcccatccagaccaccccgacaagatttggcgtatagcccgcaaaccattgatccattgtaccgtcgaccccgctgaacggcaattgggtggagcctgtttttccggcaattttatagccggggaccgctacccctttgccggttccggattccacaacgttcagcagcatagatgtcatttcctgggaaacttttttcgatatgaccctttcctgcttgtctttatgctctgccaaaacttttccggtcgggctcacgatttttgtaatgatgtgcgcttcggaacgttttccgttgtttggaaacgtggtgtaggcctctgcaatgtcttcgggggaaacgccgttttgaatattcccgagcgcaatgccgagctgcttatccttctttgtgaccgggatgccgaattttttcgccgactcgtaccctttttccaccccgattttattcaacagccagacagcaggaagattaagcgatttttcgaccgccatgtacatcggcactttaccgagatattggttgttatagtttttcggcgcataaccgcctttaaacgtcatttctttatcttctagcatcgagtcggggctgtacccttcttcaagcgccggcgtataaacggtaatcggcttcatgatcgatccgggttgccgtttcagctgcgttgccctgttgaagccgcggaatactttttctccccttcctccgacaagcccgcggacgccgccggttgacggatctacaagtattgcgccgctttggatgatctgaccggatgtgccggaaggaaagagtgatgatttctggtaaacattttccaatgctttttgaatattttgatccatggcggtataaattttataccctcttgttaagatctcttcctgtgtcagtccatactgatcgattgcctcgtccagcaccgcatcgacgtaatacgggtatttgcctgtcagtgcatctgtttttttatcttttagcacaagcttttcgctttttgcctgtttatactcggattgcgtgatcatcccgtactctttcatggcgaaaagcacgacattacggcggtgaatggcgcgtttataatgacggtacgggtcgagtgcattcggtgaattaacaaggcccgccaaagttgccgattcggataagtccagatcttccacgtcttttccaaaatatttattggccgctttttcaacaccccaggcgccttccccgaaatagacctggtttaaatacatctccaaaatttctttttttgtgtaatgcttctcaatttcaatcgccaaaaaaagctcctgaattttcctttttaatgtccgttccggggaaagcagcgcatttttcgttaactgctgggtaatggtgcttcccccggcagccgcccctccgatccggatatcttttaaaagcgcgctcaaggtaccgatgatatcaaacccatggtgtttgtagaaacggtggtcttcgatggctaccaccgcattttgcaggtctcccggcatttttttaatcgatacgccttccgagcggtttgccgaaattctgcttgctgtgtccccgtctttgtcataaataacggtcgtctgttccagccctttttttaactgcccgacattcgcgctttttgcataataagcaaaaaaagctaaaaagccaagcaatgaaagagaagctgccagaatgatgatttgagtcatatgggctcttttccaaatttttttgaacccgtcccaaaacacccggaaataaggtttgattttatctatataaggtttgaatttgttcatatctgttgatgtcctcatctttccccaatctgtgaaccttctatctcaaacaccatgctgatttgccctttagcaaaaggatattatgaatggccggaaaaatcaatgacaactatagaaaatacagtgctttaaaaccgtaaaaatgcactgaaaccgtttttttccttctggttccgggtaaagaaaagagggtgtttcaagccatacatgaaaggatgatggtacatgtacaagcatattgccattgcatacgatgactcagaggggagccggaaagcgctggacagagcctgttcattggcccttgccttaagagatataaaattatccgttgtccacgtgaaccaggaaagtgaagtggcagcaccggtaccggatgaaaacatcggcgtgccgccaaccatttccgtgccggggctggacggtcgggtttacccggttgacccaccgccggttgatgaaccttccacacagcaattcatcttaaacgatgcggaggaagtcatgaatcatgcccgcgaattattagatgcaaaaggggtcaaagccgatacccatattttagaaggcaaggtggccgacagcatcattgatttcgcccgcaacgagaatgtagactgcatcattactggaagcagcggaaaaaatgctgtgaaaagtctattcattggaagtgtgagcaaaagccttgtaaaaaatgcggaggtggatgtgcttgtcgtgaaataaccaaccatcggcaccgctaatggcaaaaatggaagggaaacaactattttgacaatagacaaaaaattgtatccctataaacgataacagattggcaaacatgatcgcattctggtggaaaaccgtggcggacgtacaggaaagtcgcaattccagaatgcttttttgtattctttgataaacgtccaaacttctgtcttccgtcttgcatacattaacattgcatgacggaaagatggaggtgaaaaatatgggcttttggggctgcggatacggcggctatggcggtggctatggcggcggatacggcaacagctttgcgctgattgttgtactgtttattctgctgattattgtaggtgccgcatacctgttctaagaaccgaggcccggccttattgggcttgggcccggcttctttttcccaaacgcttataagaaaaccattcgtacggtttctacataccactcccgcgctgttccaccggcttgccgcagctgcatgtcttttcaaacaatcaaacttttcctacctgatttgcactggaagaaacggttgctgccggactgccctttccatcgtaaagatgacatgcgacataatggtggtcttcaatctccagccattccggttttacacttgcacatatatccattgctttcgggcatcttgtccggaatacacacccgctcggcggcgtaaccgggctcgggatttccccttttaaaataattctttcccttttatcttcaattttcggatccggaatcggaatggccgacagcaacgcttccgtgtaaggatgcagcggtttgcggtacaggctcttgctctccgtcaattcgactagatggccgagatacatgacgccgatccggttgctgatatgctttaccatcgataaatcatgggcaataaacaagtaggtgaggtttttttccctttgcagttttttcaatacattgacaacctgggcctggacagaaacatccagtgcggaaatcggctcatcgcaaatcacaaactccgggtcaagcgcgagcgcccttgcaatcccgatccgctgccgctgccccccgctgaattcatgcgggtaccggcctgcatgctctctgtttagcccgacttcttcgagcaattcatatattctttcaagctcttcacgtttgtttttataaatgccatggacttcaagcggttcagcaaggatctcgcggacagtggaacggggattcagagaagcatacggatcctgaaaaatcatttggacatttcttttcatcagaaaacgctcccgctcatccagtgcgtggatatctttgccgccgtaaaggatttgcccttcagttggggtgtaaatccccatcatcagccgccctgccgtcgattttccgcatcccgattccccgacaagcccgaacgtttcccctttataaatatcaaaagaaagatcgtccaccgcttttaaaaattgtttcttcccaatctcaaaatattttttgacatgcttgacttccaacagtttttccatcatggtgcactcccttcacccggctgctgtaacccgtattgcttttgcggcaggtttgccgcattcttccggccaccaacgccgcgctgcacttcattcgcaaccagttgcgttgcggtttcccattgcgcggctttacatccagtaacgccgcgcacagcatagttctttttcgtaaatcgttccttccatatccagcagttcaacaggccggcctgttttcggcgagtggagtagcttcccctcccccgcataaatcccgacatggtggatggcgcctcttccttcctcatgggcaaaaaataaaagatcgccgggtgcgatgcttccaagcgggacggctgctcctccttttgcctgttcatgggcgtcacgggcaatggtcctgcctgtcgcagcaagcaccatcgtataggaaaatcctgagcagtcatagccatatccgctcatgccgccccataaatacggcaggccgagaaacatttttccggcgtcaagcatatacctgttctggctgccgggactgctccctttcaactgcacatcttgttttttgagcgatgccggtttcccgtgcaccgtttttacaacgaactggtcctttgtttcatccactacaaaaaaacgtgtttgaaagctcacttcaaataaagggagttgattttcatcatagagcattgcaaatggttttttgacggcacaaacagcagcatcttgcggccatccttctccctgcttcagctggcagcggggaacccagccgggatagccgtccggatgtttgctggaacgctgttccggaacagaaatatacgcccacttcccctctgttttgtggacaatgactttccggccgtagagcacctgtgtctggattttatttttccgccaaagttcgtgccgctgttccaatgagaggccggtgagccactgcttcatattcgccgggttccggagggcttcttcgtctccggcacccggtgattgtgcggaagtccaaacggtggcgacaggggtatctaccaaataaacttgctttcccatgttcaaccccctttccctcagatttccattttgggcagtatcaagcgggaactcccccgcttgatactgcccattcttttccattcgtccagacagccgggctgcggataatgcctgccatatggctctcatgggcaaaccgtcccctgccaaaaacagaacattattttacattggcccatttcagttcaagatagccgacagggtggcggacaatgcctgttacatgatctttttgcaaaaatacctggttgtaaaaatagagcgggaagatcggcaagtcgtcaaacagcattttttccgcttcgtgcatcagctcgtaacgtttcgtttcattggtttcattttttgcctgctggatcaactggtcatatttcttattgccccatccagtcctgttcatcgcttgcccggttgtgaagctttcgaggaagttaatcggatccccgtaatcagcaagaaatgaactgcgggacaattggaatttcaattttttctgctcagcctggaagacattccattccatattggcaagttttacctggatgccgagattttcttttagcatctgttggattgtttcagcaatttttttatgaaccgcgtccgtgctgtaagtgagggtgacctcaggcagtttcgtatacccctcttcttgcattccctttttcaggagggttttcgcttcttttgcatttgaagtatacaaattgccgccttttttccggaagtcgttgccgtcaggttcggtaaacccgtaagaaacaaaaccgtaagccggcttttcatcattttttgtgacatatttgacaatttgtttctggtcaatggccatcgcgaatgctttccggatatttttattctggaacggttctttattgacattaaaccggtaaaaataagtgccggcctggtcctctactttcacttttccttccttaaacagccgggctgccatatctgccggaacatctgaaacatccagttccccgttttggtacatttggtattcagtgttcggatcgtcaacctccgcccatttcactttatcaagttttacatttttggcatcccaatagttttcatttttttccatgatgaaatggtcatcgtgtttccattctgtgagcttaaacggcccgttcgaaacatacgttttcgcttctgcaaaccatttcggatttttttctgccactttctcgttgatcgggaagaaagcagggtttgcgatgacgttcagaaaataagattgcggcccggttaacgtgacttccagtgttttgtcatcggccgctttcactttgacgccgtcttttgatccttttccggtgttatacgcctccccgccttcaataaagtatcctaaaaatgcggcaggcgaagcggttttcgggtcgagcattcttttccacgcatattcaaaatcacccgctgtcaccggatccccatttgaccattttgcattgtcccggaggtggaacgtatacgtcttgcctccatttgtgacatcccagctttttgcaatcgcagggtgcggcttattgtctttgccgaggcggacaagcccttccattaaattgttcagtgcattccatgaaacggaatcgaacccgattggcgggtcaaatgaggtgggctcagacccgttgtttaaatttaataccttttctttgctgcttccacccggactgttttttgagcttgactggctcgtacaggcagcaagcgaagcaataagcgccaaactgacaatcatactccaaaatttcttcatacatttcccccttttcttttccgcattgcgggcagccctgacccgtttgtcccccttgcagtatctgggcgccgtaaatgcctgttttctatttcatctacaggcgtacacccgtagttgaaaacgcaaattttgcccgttcgtcctgcagccaacaataaacctgatgggaagctgattttttcgtgcgaaaaggttccacacggctgcatacttccattgccattgggcatctcgccgtaaacgggcaaccgggaggcggcgcaaataaatccggcggcgtaccgggaatcggaatcagttcttcctcttccatatcaagccttgggaccgagtttagcaatccttttgtataagggtgttccggatgataaaagatttcttctcttgtgccggtttcgacaatcttaccggcatacatcaccgctatccggtcggcaacctgggccacaacaccgaggtcgtgcgtgatcaaaataatggatacgcccgtctcccgctggattttcttaaacagttcaaaaatctgcgcttgaatggtgacatccaaagcagtagtcggttcgtccgcgataatgatctccggattgcaaatcaaagccatcgcaatcatgatccgttggcgcatgccgccgctgaactggtacgggtattgttttaaccgttcatgcgggctcggaatgccgaccatgtgcaacatgtcaatgaccgtttttttcgctgcctcgcgggatagattttgatgctcctgaaccgcttcaagcaactggttcccgatggacaaagttgggttcagacctgtcatcggatcctggaagatcatggagatttccgccccgcggattttccgcatttgcttttcgctgtattttaaaatatccgttcctttaaagtggatcgagccgcttaattgtttcacattattattgggaagaagcttgaggatcgcttgcgatgtcacgcttttgccgcatccggattcaccgacaatggcaagcgtctcgcctttgtttaaataaaagttcaccccgcgcacagcctgcaccgttccgccgtatgtcgaaaacgaaacgtgcaggtcttccacttccagaatcttgttcatttccgtcacctcctcagcttcggatcgagcgcatcctgcagcccgtcgccaagcacattaaatgcgaacatcgtcagcgaaataaagaatgccgggaaaaataagcgccaccactcgcccgttaaaatcgccgacaacccgtcatccgccatcacgccccagctcgcatgcggcgcctgaacccccaatcctaaaaaactgaggaatgcttcactgaaaatggcacttggcacggtcagcgtcatttggacaataattgggcccattgtattggggagcaggtgtttgcggatgatccgtgacgttttggtgccgaacgttttggaggccattacaaattcatagttttttatctgtaatacctggccgcggacaatcctggccatgccgacccatcctgttacggtaagcgcaacaataattgtgccgagccccggccccatcacaaccatcaacaagatcacaacaagcaaataaggaaggccgtacagcacttcaataatccgcatcatcacttggtcggtgcgaccgcctttgtaacctgcaataccgccgtatatcaccccaatgaaaaattcaatgatagccgccataaacccgacaaacagcgaaatacgcgcgccataccatgttcttgaaaacatatcgcgcccgagctggtcggtcccgaaccaatgctccttggagggcggcaaattctggttcgttagtgacagtttcgtcacgctttcaggtgcaatcagcgggccgatgatggccatcatgatcaaaagaatcagcacgacaaggccgagcatcgcgagcttatttttggcaagccggttccatacatcatgccagtatgatatgcccggcctgacaacggcttcctgcattccggcttctttctttttcgggacaaaccattcatccggaatctctgaaatggtatccactctatcctgattggctgtttgcaagatgtccaccccttattgctctattttatgcaccagattttgtgaatcgggacgatggttgtttttgctcgcctgcaccttgtgttacgaaaagccaaggcccgatacttatgtaaagccgggctgcttcttttcgaaaccagggctcactgttcttttttatgtaatttgatccgcggatcgagaatgccgtacgcgatatccacgagaaacagcataataatcaaaaaaatgctgtaaaatacggttgtccccatgatgacaggataatcccgattattgatgctttcgacaaaatactttcccatgcccggaatggagaatattttttcaatgacaaagcttcccgtcaaaatgctcgccgtcaatgtccctaaaatggtaataaccggcatcagcgcatttctgagggcatgtttgatgataattttaacaggagaaagaccttttgcacgggcggttttgatgtaatcctgcgtcagcacttccaataggcttgaccttgtcaggcgggcgatgatggccatcgggctgactgccaaggcggcagttggcaggatcatatgcgccggggatgtccacgttgcagccggcaggattttcagattgaccgcaaactcctggattaacatcgttgccagaataaagttcggaatcgagatgccaagcacggcgatggtcatcgccagatagtcgatgatgccgttatgttttaatgcagcaaaaacgccaagcacgatgccggataaaaccgcaaccagaagtgctgtcataccaagttcgaatgaaaccggaaagcccctgcccagcatgtcgtttaccgtctgggacggctgtttgatggacgggccgtaatcaaataaaagaatggatttcacataatacaaatactggatataaaccggctgatccagatggtactgcgcctccatatttctttgcacggcttcggatgtattgcgttcttggttaaaaggcgatcccggaatggcctgcatcatgataaaagtcagggtggtgatcacccacagtgtgacaaccatggcggcaagccttttgagtacatactttgccatacgcagacaccttctcacgtttaaaatgggcatactgttgtggtatatttttattattaaataaatagacgaaaaattcaatagcgttcaatatttattttaattccacaatatcaatattttcggaatacaggaagcgcttttattttttcttgttctccaccggtagaagacaggagttaagcaagcgcctgcaaattttccggtttaaaaaatacgaggaggcaagcatttcataacagcaaacggactaaacggttttacaggaagcgataaaggcggaaaatattttcaaggaaacaggatcctttatggcggccaaagcttcaggatgccactgaacgccaatcataaaacgggcattgcgattttccaccgcttcaatgattccatcaggcgcacgagcagaaaccataagcggcgctttcacggtccggactgcctggtgatgaaaagagtttactttcatcgtttcgcttccggcccatttttccagtaaacttcccggcaaaacatggaccgtgtgggaaagatgggaacgggcggcccgctgtttgtgctgcaacagcgggggttttccctggctgtaaatatcctggaacatatccccgccggatgcaacagcgagaatctggatgcccctgcaaatggcgagaatcggcacatccgcctgaatcgcaaaccggcatagcgcaatctcaaatgcatcgcggccgggctcaatttcaccgagccccggaaccggctcttccccgaaccaggatggatctacatcacctcccccggaaagcagaattccgtccgttttggacaataataaagggatgtccgcttcaccgccggccggaagcaataccgggacgccgcccgccatgcggacagccttgatgtagtcatcagccaaatactgggaagtctgattggcactgcatgtaatgccgatcaccggtttcatttttcatcatcctttcgcattttttgtatcaacagcacgggcgcctgtctttgcgcccggtttttctgccaggcccagcgtgaatggccgtgacgtttatgttcttgctgctttcgatatcgcggatgcccttcttttttcgcgcccgttatcccgaaaaaaagacgagcgaattgcctttcattttgatttaatgcaaggccgtctgcgacatagtaaaataatgctaaacggacgattggcaaacctcatgtgaaaaggatgtgcctttttatgatacatattatggcgatgacaaaagaaaatgtactgaaagcccccgcttccattgaagaattggaagggaccagctggaaatggtattggattgatttcgaccagccttcacaagaagaaatattaaaactgcgccatccgctcggtttccatccgctggccatcgaagactgtattcataagctgcaacggccgaaactgaatgattacgaagaccatgtcttttttgtattccaaagcctgaatcccgacaggctgcagaaagaagaattgaacctgtttctcggggagcattttgccgtgacctttcaccatctcccgtcaaaagaaatcagcgaagtgcgggataagctgaaaaaaacggataaaccgggcaaatgggggccggccattattctttatgaagtactggacaagattgtcgatcaatattttccttatttgtataagattgaagaccgtctgaatgaaattgaagataactcaaaaaatgaatcgatggaggatctgcttacaagcctgtattcaacgaggcatgatttgcttgtgttaaggaatacgattatgccgatgacggatcttgtgtaccggatgctgaattcccatacgattccaggcattcaggaaaaacgcgcgtattttcatgatatccatgaccacttgctgaaactatccgggatggtggagtccaatcgtgagtttacgaccgatatccgggacagttatttgtctttaaactcacaccaaacgaaccgggtaatgaagattcttaccattttcactacgatttttatgcctttaacttttattgcaggggtgtacggcatgaatttcaaatatatgcccgaactggaatggaaatacggttatttcgctacccttattgtcatgtttctgatcggcgccggcatgacttactggtttttcaaaaaaggctggctgaaatgaatttgcaaacaccccgcatccgcccagaataaagcaggactggaacaaggtgcaaagcaaaaaagcggaggcgcctttttcaggcatggcctccgctttggtacacaaaacccggttccgccccgctccggtccgccatttcgttggcatggtcaatatagcggtgcagcgcaaacaggcatctttcaattacgttatagtcatgcgaaaaatgataagcatgtaagacatgctcaatttttttggaaagaaaatcatctttcgtccgcaccatcaaaatcagcaaattatcccattgcgagcggtgtgtgtaatataaagcgcggtcataatcaatgggattcatcccggctccccctttcttgtgcatttgcttgaaaaaagcaaatcctaataaaaggagtcaacattattgtatgtgtttttcctgattttgcgcgctgaaaaacttgcctggagggaaaacaaaaggctgttatcatttggaatgcattttgctggttttcagcccgtggcaagcttttatgcagccgggtcagaatcattcggatcttttttaccggaaataacgggtgatttccagtgctttgtcgcctgctcgtgcgcgggctgtttcatttctcgtgatcatgcgaaaatccttctttgtgtcctcatgttttttccctttcattcatacattggaaaaaagggtgacttttaaagggaggaacatttcatgcgtgatcatgaaagcctgcaatatgcgattgatgagataacggaaatcgcgtccggttttgggcttgacttttacccgatgcgctacgaaatctgcccggcggatattatttatacttttggcgcttacggcatgccgaccaggttttcgcactggagtttcggtaagcagtttttcaaaatgaagttacagtatgatctcgggctgagtaaaatttatgagcttgtcatcaattccgatccgtgctacgcctttttgctggattccaacacgcttgttcaaaacaagctgattgtggcgcatgttttggcgcattgtgattttttcaaaaacaatgtccgttttcaaaacacgaagcgtgatatggtggagagcatgtctgcaacggcggaaagaatccgggcatatgagctgaaatacggtaaaaaggaagtggagcaatttattgatgccgtgctggcaattgaagagcatatcgacccgtcgctcatgcggccgaaattgaactggagcatggaagacgcggaagaatgggatgaggaaccgaaacgcaaagagggaccttatgatgaattatggtcgcttgatgagaaaaagccggaacaaaaagcagtgaaaaaaacgaaaaagttcccgccacagccggaaaaagatattgtcctttttattgaacaatacagccgggaattgacggaatggcagcgtgacattatgaccatgatccgcgaagaaatgctctatttctggccgcagctcgagacaaaaatcatgaatgaagggtgggcctctttctggcatcagcgaatcatgcgcgaacttgatttgacaacagatgaagcaattgaatatgcgaaactgaatgcgggcgttgtccagccgtccaaaaccggcatcaatccgtattatttgggaatcaaaatttttgaagatattgaagaacgctggaacaacccgacggaagaaatgaaaaaacggggcatacggcctgggaccgggcgtgaaaaaatattcgaagtgcgcgaaattgaaagcgatatttcatttctgcgcaattacttgacaaaagaactggccacaagggaagatatgtatttgttccaaaaacaggggcgggactataaagtggtggacaaagagtgggaacatgtacgcgaccagcttgtcagcatgcgggtaaacggcggtttcccatatttgaccgttacggacggagactaccggaaaaacggggaattgtatattaaacactggtatgaagatattgaacttgatttaaaatacctggaaaaagtgctgccctacctttaccagttatggggcagaaatgtccacctcgaaacggttgtggaagaaaagccgattgtcttctcttatgacggaagaagcgtgcaacgaaaatatttgtaaaaaggcacgggccccgtttcatgcctgggggcagcctgtaaaaaagcggcgaaaaaccatttgattttccgccgcttttcagatgttttatttttctacaaccggagttcaataatcggccttgtaaatttccggatatagtaactgccgagaaataaacagatgccaagtgaaaagacaatcagcagcaggtaattgcccgccagccagtcaagcacattgggggaagcggctgcctctattgtctttatgataaaaccgtgcagcaaatacacataaagcgtgcgctcgccgatttttgtccacttgtaccctttgctcgggattaacaggaagaacccgagaataacaagcagcgtgacagcatattgggccagccggatcagcccgctaaaccagtattccatccccatgcctgcgtaagaagtatcgccaaggagccacggcacggcatctttcgggaaaaactggccggttgcaagcgtgatggcacacagaatcaaaatgccagccaccggcgcgtaaggaatattgcggattttttgcaaatgccttccttccagcaaaaagccgagcaaaaaatacggaaaaaatacgaatgtgcgggagaggctcagaaaacttccggcctcatcccagtagccaatcccaatgccgagcgctgccgcagccgcaagaccgaaaaagtggaaacgggcaaacaaatggagcataaggttccaaaaaaacaaactcagcaaaaaccataatgtccagtgcggttccagaaagtttaccgtcaggtgcgattcttcgcctgtataataataataaacggaataaatacattgaaaaatgaaatacggaaccaaaatctttttaaaagattttgaaatatggcctttttttcggtatgcttttgaaaaatagcctgaaataagaataaatgccggcatatgaaataggaaaatgacggtatacagcgtaaagaggaaattgtcttcggttttaaacgggctgatcaggtgcccgagaacgacaagataaatcagaataaattttgcattgtcaaaatacgaatttctttttgctgctgacatctgccatcctccgttcctgttgtacagcaagtattgcgatgtcgacgcctttcgttttctataccccctgcacggcaaaatgaatcaatattcatgcaggaaaccctgcggtttctattatacaaactttatattacaaaacggtaaaaattcatttaaaccaagatgatttttaacagcattgcaaaaaggccggtaccggcctttttgatcgcaaatatggttggtttgttttgtgcaaggggtgggcagcatctgtgacgctctggaacggccggccaggaacccctcctgcctgcttgtatttcttaaattccgctcccggctttttgcccggcaaattgtgcagttaagtccgtataaatttttttcgccattactttataaccttctgctgttaaatggatgccatcatcactgatgaggcccttcaggtcaccggcttttttgatcgctgtccgaacatcaatggccgggacgttcaactgtttgatgaattttttcaggcacctgttatattggccgtgccagtgttcaatgccgcccgacaatccaatccagtggccgatgcttttcccaaagcgggcgctgatggactggtagtagcgtttcgggtcaagcggcggcagcgttagcaaaacgggcgtaatgccctgttcttttacatttttgactaaatgcctgatattgtccgcataacgctcaaggggcacaaccgggacatgcgtatcatctggtctctctgctacttcgttccatttgaaattgcagtcattaccgccaatacagatcagcacgacatcgggatgctcgccgattacatctttgccgagacgctggacaagcaggtcggaattatcattgaacacccctttattgacaatctctgtgctgctgtcgccaaaatactgctgaagcactgcgggataattgtcttttaaaatccggagccttccttttatacaagttacacctcttgtaatactatccccgaaacaaacaattttcatttgaggccctcccttgaatgcataatcatgcaaaaagtcagaacgatagacatcatttattgtaaacttgccgggctgattcgacaagtgattgcaccgtccacgggcaaacgccctccgcttttctttgtccagctgtggctcctagcccctagggtcgaataatccgtccgtcatgaagtaggggcttcattccggccgaaacattcgccggccggggctaaacagtcgcctccgcttttcattttttgggttggatactataatttacaaggaagggattgatgaaaaggaggtaaggggttgagtagaggacggagggaagaggtttggttttttgcctgggcggtttcggtggttgccacgctcggcagtctttatttttcagaaattaaagggtatgaaccgtgtgaactgtgctggtaccagcgcattctcatgtatccgatgacggtcttgatcgggattgccgttgccaggaaagattaccgcatgtcgctttataccgctgttttgtccggaatcggcatgtgtgtgtcactttaccattactgtctgcaaaaacttgcctttttttcggacaggcttcctgcatgcggccgcatcccctgtacggcggaatacatcaactggttcggctttatcaccatcccctttttggctctcacagcgtttgtgctgatttttatttcaagtctcatcgtttggaagcaggctcgcgcttcccattaaacacaactggaggattataatgaaaaaaatcatcctttttttggccattgttctcattgtttttggcgggattgccggaatcacaaagtacaagcaatccaggcaggcgaaaaacaacccgtatgcacctgcaaaaagtgtgagcaaattatcggcggaaacgcgcgaccagctggatgaccccctttaccagaatattattttgccaaaagaattgaatcatgatttaaaatccggcaaagcggtcaccgtttattatttcatgccgacctgcccgcattgcaaacggactacgcctgttgtatcaccgctcgcgaaagatatgggcatcgatttgaaggaatttaacctgactgaatttgaaagcggctgggatgactacaaaatcaaagcgacaccgacgatcgtccattacaaaaacggcaaagaagccgcacgccttgtcggagagcatacaaaacaggagttccgccaatggtttaaagcacatgtaaaaaaataaggctgcgtgcttgcaaggaaccctcaaaaaaataatgcccggtttttccgggcattattttttacacaagcaggcgattggctgcttttttaaacatgctaaacgtatccgtatgcttcttctgaaaatgggaaaacgaaaaaggaaaatgcaaaccaaactgttcaagcgtaaatttattaaattcaaacaggccggcgtaatgctcgtcccgcttattctcttccgtttccaaaatggaaatgatggtctgcagactggcaatcatctgataccctgcttttaaagtgccgatttgttctgttgggtcatccggcagggcaagcaccctgtcgcgctggaatgcggtgatctcctcatccgtaaagtaatcaggaaatacttctgtaaacatatggcggaccaattccgcgatcttatccatctgttcttccgtagcagcataaacgatcttcacagcagtcccaccctttttgaaaaatccatatgtaagccaaatcataggcgcaatataagtacagcatagcataggaaaacgggaaaaaagtatggtaaatgtgaccatggccctgccccctaaaaagattggattttttctgaaaaagcgggacaaaagcccaagcctcatagccggactttcttccaacaaagcaacctgtttttagctttttgacgaaagtcgaaaattggaaccgtatacaaaattttattttcgacattcttcttttatcttcgcaggaaatcagataaaataaagacgtttgataatgaaaaggatatgaggaggatcttacatggtatttaaaaacaagaaagacaagtttacagtgctgtttggccatatttcgaccaacctccgggaagccaccaattactttgccgactataaaatccataataaagacgatttaaaaatttttactgaaaaaatgaaagaatacgaaacgaccggggatacttacgtccatgacatgattctggaactgaacgatgcctttatcaccccgattgaacgggaagaccttttgtcactaacgaacagcctcgatgacgtgctggacggcattgaagaagtttccggattatttgaactgtacaatatttaccaggcggacgattttatggtcgaatttgttgaaatgatccgccgctgtaccgacgaaattgaaaaagcaattgacatccttttttcgaaaaaactcgacaagatccgcccgcatgccattaaaattaaagaatttgaattccattgtgacgaaattttaagaaaatcattaattcacctctttcaaaacgaaaaagacccgattcgcctgatcaaatataaggatttgtatgaaaagatggaagatgtggccgactactgccagacggtggccaacattttagagacgattatcatgaaaaatgcgtgaggagtctgctgaatggatagcattttagtattaactgtcttaatagtaatttttggatttggattcgacttcatcaatggattccatgacacggctaacgcgattgcaacggccgtttcgacaaaagcattaaaaccccggcatgcgatcgtaatggccgcgcttatgaattttctcggcgccatttcttttacaggtgttgccgagaccattacggaaagtattgtaaacccgttcacccttgcaaacggacaggtggtcattttgtcctcactgatgtcagcgattatttggaatttgattacatggtatttcggcattccgagcagttcttcccatgccatcatcggatccattgccggcgcggcgattgcctcgtcaggttttcatgtaatcgaatatcgtggttttatcagcattattgaagccttaattttatccccgatcctcgcttttacggtcggttttacggtttacagcatttttaaagttgcatttcagaattttaagcttgcgaaaacgaaccgacacttccggctgatccaaattttcaccgccgctctccagtcttactcccatgggacaaatgatgcccagaaatcgatggggattatcacaatggctttgattgccaaccattatattgccgagaaccatattccattctgggtccaggtcggttgtgcggcggcaatggggcttgggacatcgatcggcggctggcggattattaaaacggtcggcgtcaatattatgaagatccggccgattaacggggttgcagccgacttgagttcagctttcattatttttggtgcaacatttatccacttgccggtcagcaccacccatgtcatttcttcttccattctcggggttggttcggcccaccgaattaaaggggtcaaatgggatactgcaaaaagaatggtgatcacttgggtcattacccttccgatttcagccgttttatccggtgcgatttatcatattgtaaaccttttttggtaaaacgggctgaaaaaagagcagcgttaagcatgctctttttatatgcaaaagaaatttacatagacaattgaaaaatttccattttatgatacatttttaataaaccattcagaactgcgggggatagatgtgagaatcgaagacatataccggaacttgccactgcttgaaacggaccggcttgttttaagaaagctcaagcgggatgacgtgctcgatttattttcctatgcgtcaagaagtgaagtagcaaaatacgtgacgtgggatgcacaccggtctgtccgcgattcgaaaaattttataaattttgtgctcagccagtaccgcgaacacaagattgccccctggggaattgaagacaaagagacacgaaagctgatcgggacggtcgattttgtatggtggaagccggaagaaaggacggccgagattggctatgccctttctcctgagcactggggaaaaggcatcatgacagaagccgctaaaaagctgattgctttcgggtttgaacacatgtatttgatccgcatccaggcccgctgttttgcagaaaatatcgcgtcggcccgcgtcatggaaaaagccggcatgacctatgaaggcactttgcgcaaagccgtttatagaaaaggaaaacattgggatctcaaaatctattccattttaagagaagagcatttttaacggccatagcatgaaggaaaggagatatccctatggaatggacaatagacgacagaatttatgatacattttgggaagctgaggaagtaggattctccagtgttagtgatatgggggaaggaagaggattcattacgcctgatttgaaagttgcaagtgtcctttcctacgctttatgtggattaccggatgtaacataccttgttcatacagaagaatttttggaagatggcattcttaaatataagatatgggtagaaaacttatgagatcacagcacgcggcacacacagaatcaggtgaatcacccgttatcggcacccgcaaaaataaggggcccgcatcagccgttgtgcagcccctttcttcttatgccaaagctttgtctgcttcctttgaaaagaaacttttcatcgcatggaaaacatctgctttttgtttcagcacgtaatatttaaatttctcatctttaatatttttataggccgacatgagggtgctatggcggttgtactggttcacttccccgtagtagaacatattcgagactttcataatttcctggacaagtttcacgcagcgcgcattgtctgatgtcaggttgtcgccgtccgaaaaatggaaaggataaatattaaagcggtacgggtcatatttttcattgatcaggctgagcgctttccggtaagccgatgaacagatcgtgccgccggactccccttttgaaaagaaatcttcctctgatacgacttttgcctctgtatggtgggcgataaattcaatttccacggtctcgtatttcgtccgcaaaaaacgcgtcatccagaagaaaaagctgcgcgccatatacttttcccatatccccatacttccacttgtatccatcatcgcaaggacaaccgcttttgattccggtttttccacttcattccatgtgcggaatttgagatcttccggcacgatcgggtgaaaggccggtttgccattcatcgcattccttttaaacgccgacatcatcgtccgttttttatcaatattgcccattagccccgttttccggatatcgttaaactcaatcgcctctaccgtgttctcatctcgctctttcctttgaagatttggcagttccaattggctgaacaatgcttcctcgatttccatcagagatacttccgcttcataatagtcttctcccggctggtcgcctgctccctggcctttgcccggtccctgctcgggggaaccgtcgcgtgcaatgatatcgccgactttggaatcgccctggccctggccgacatgtttatttttatcataattatagcgaattttatattcgtccaatgaccggatcggtattttaacaacatcccggccgtctgacataatgatgctttcttccgtaattaagtcgggcagattgttgcggatggcttcctggaccttttcctgatgtcggacctggtcatcatgccctttgcggtggagcgaccagtcttcctgtgaaagaacaaaatgcttctgatcctgtttatccatgctcatcctcccttttttgaaaaatttgccgagaatttcgccgtcaccataccggatatcctaacatatgctattttggcgtttaaaaacttggattatcacatttatgattactctatcttatgcaatagggcagaatatttgacatttttcttttagaaacaggctaacgccggataaggaaaaaaccgggctgatatcgcccggcttccggctgccggattaccggttcagcaagctcccgacatagcgcagcaattcattggccgatgtggaattatagccgtaatcatcaattaaacgcgccaccacttcattgatcttcttcaactgctgttcatccggcgtttttgtggatgttgtaatcttgacaacgtcttttaaatccgcaaacaattttttctggatggcttcacgtagccggtcgtgtgaattataatcaaaccgtttcccttttctcgcataagccgaaatgcggatgaggatttcttcccggaacgctttcttcgcgttttccgaaatgccgatctgttcttcgatcgaccgcatcagtttttcatccggattaatttcttcgcctgttaaaggatcatgcagcttcactttgttgcagaatgcttctacattgtcgagataattgtccatcagcgtttttgctgactcttcatacgaatatacaaatgctttctgcacttcttttttggcaatttcatcgtattctttccgcgctaaagaaatgaaattcaaatacttctctttcaattccggggtaatcgacggatgctggtcaagcccttccttcaatgacagaagcacatcgagggcattgatggatttcatttcttttttgatgattgtagaggaaatacggttgatgacatagcgcggatcaatcccgaacatgccttcatcctggtattcatttttcagttcctttacatcctgtgaattgtacccctctactgccatcccgtcatacaagcgcattttcttaagcaaatcgatatccgcccgcttcggttcgcgcaaccttgttaaaatggtaaacatcgccgcaactttcagcgtatgcggagcgatatgaatatccgccacatcgctttcccggatcattttttcataaattttctcttcctcggttacccgcaaattatacggaaccggcatgacaataatccgtgagtgcaaagcttcgtttttcttattggcaataaaagagcggtattcggtctcattcgtgtgcgcgatgatcaattcatcagcagaaatcagcgcaaaccggcctgctttaaaatttccttcctgcgtcagcgacaacagatgccagagaaatttctcatcgcatttgagcatttcctgaaattccataatgccgcggttggccttgttcagttcgccgtcgaaacggtaagcgcgcggatccgattcggaaccgtactcggcaatggtcgaaaaatcaatgctgccggttagatccgcgatatcctgcgatttcggatccgacgggctgaacgtgccgatccccgtccgcttgtcttcggaaaaaaagatcctttcaacgagcacgtcttcaatccttccgccatactcttcctccagccgcagcatattcaaaggagacaaattgccttcaatccggataccgtattcctcgtaaaaatccgcccgcaaatgttgcggaatcaagtgaagcggatcttcatgcattgggcagcctttgatggcaaatacagcgccctgttcagtccgcgaatacgcttcaaggccccgttttaacattgtcacaagcgtcgattttccgccgcttacaggtcccatcaacaataaaatccgttttctgacatccagccttttcgcagccgggtggaaatattcttccaccaatttttcaagcgcctcttccaaaccgaataattgatggctgaaaaaacggtatttttttactccgtccacttcctccacaccggcatccttaatcatattgtaaactcgggaatgagcggattgtgcaacccatggcttttcttttagcaagtcaagatactccctgaacgttccttcccatctcagtttttcctcttcttcacggtagtttgtgagtttcctcagaatatccatttcgtacctccccttagtcttgttgaagagacgtttatataatctatgcccccaagcgagggaacatgataaaaagagacaaccttattcgggacgaacggacagcgataaacgcgaaaaacgaataggaaaaatttcgtttagggagattctggtggataaggtacgttcaaaaattgaaaataggtgcatctttcagtgaaatgggctataatgaggggcaaagaaggaaaaacagggaggatatcgaagtgaaaacgttccttattatattggtagcgatttcattcttgtccgccattttcacggctggatacgaagacaaaggggaaaacttccgcgagcaagagccggagtattaaaatgctgctcaaagatttttttgcaccggggatcttccgtgggcaaaaggccaggtgatcccgaccatttccggcaatggcgcttccacacacgaaaggccggggaaattcagcctggcagtgtggcagggattttgagcgggcaaggcctagaaaaaatgcagcttaaaacattcggaagggatttttcaccgggatctttcgtgagcacgggccggatgatcccgaccatttccggcattggcgcttccacacacgaaagggccgggcgatgaaccagcccggccctttgtcattttaatcctggataatgctgctgccgcaacgcttcatatacaaggatggcggcagtattggaaaggttaagcgaccgcactttgtctgtcatcggaatacgcaggcagcggtccttatttttttcaatcaagtcattcggcagccccgaggtttcccggccgaacatgaaatataaatttttgtccggatcgctgaaatcaaaatccgtaaacggcttttcgccaaacgtctcaatgtagtatacttcgccgtccgcatttttttcaaaaaattcttccagtgaatcataatagacgatattcacatgcttccaataatccagcccggctctttttaacattttatcatccgttgaaaagccgagcgggcggatcagatggagcgttgtcccggtccccgcgcaagtgcgtgcaatattgcctgtgttggcgggaatttccggctggtacaatacaacatgcaagctcaacatttgtcacctcgggacttattataacacgtttctcaactatcatcttcaatggtaaaaaacttgtacttgatattcggcgtataggcggaagagtcttcatacgtccagtaccgtttacggctattggtcgtatgggcattcacaagcggcatcccgtaataatcataacccgtgacaatgagcgtatggtcaaaccggccgtccccctggaaatcgatacaaatgacgtcaccgtacttcagctcctgcggtgacgaaacttcctttgcgcgcaaaccggttttagaatactgcaggtatgtcttaaacgaatgtgcaaccgtccagctgtaactccagttattgtgcatcatccaccagccctgtgccctgtccgggtatccgcgcatcggtgccccgccggcgtgaaggcattgcgagatatagttcgtgcagtcatccgtaaacgatttgtaagccggattaaaacggttccaccacttttccgcatactggacagctttcatgcggtcatacacgtatgcgatccgttcgccgccagctgctccagttttctgctcctcatcatccggcagaggaccgcaccattccggaatgtccggcacaagttcctcgtcttcataaagccttccatcgtaaaaagatgcttttctttcctccactgcttcttcaatgtaaaaagccgctttttgtttgatcatatactgcatatgcaccgtataataaagaaagctgtggcttccctcctggtcagcccgggttacttttgcttccgctttcacctttacaatccgggcatcccgatttgaaagccccgtcttttttcgttcaatatcttcaaattcccgctctgttcctcgcccggtaaagtgagcaagcctgttttcaagatgtgcctggatttgttctttcaatcagaaaaccccctctcttcatcactatatgatgaaaaaatgggggaaatcagtatctgtatattttcgtgctttttgaaaacgcaaagattcttttgttttgctgaaaatttgcgttggcgctgcttttggcacataaaaaagcggcagccgttatcaaggaacgtgatacattcctagagctttcttgacgcagtaccgttccatgtgacgattttttacccgtatccacgaaagaagcggcatcaaagtttatcctgaaataggcaccggctgattttcattctcctgctgatgccgcgtgcactgcgatggacgtctaatcgaaaaatgcaaggcctttttcgatttcattgcgggcatccggatcttcttcctgttcgcgtgcggaaagaagtgcagcttttgcttcttccccgccgattttcccaagcgcccagcctgccgtcccgcgaataaccgggcgcggatcttcctgcaaaattcggatcagctccggtactgcgctttcttccttaaaatgggcgagcgcgataatcgcgtttcgctggatcggctttttcccgcgccacgatcctgccatatggccgaaccgttctttaaacgcgcggttgctgaggcggagaatcggttccagaagtggcttggccgcttccggttccggctccatttcctcatgaaaatgaaaatcaatccctttgtttttcggacagattgtctggcacgaatcacaaccgtacacgcgattgccgattttccctttaaactcgtccggcaagtaatcttttgtctgcgttaaaaagctgatgcaccgtttggcattcagctgcccggcagaaacaagcgcgccggtcggacagacatctaggcatttccggcagtcaccgcactggtcctcaacaggtgtatccggttcaaacggaatattggtaatcatctcgcctaagtacacataggaaccaaattccggtgtgatgatcgaacaattttttccgctccagccaatgccggccctctcggctaccgcccggtcggagagttcccctgtatcgaccatcgatttgcagcgggccccttccactttttctttaagaaaatcttccagtttcgaaagcttgtcccttaagatggtgtgatagtcctcgccccaagaagcccggcaaaagatcccgcggcgtgcgccttttttccctttcggcggattcttgattttggacgggtaggcgagcgcaacggcaataatcgactggggcgaatcaaaaattaaagaaggattcacccttttttcaatatctttttcctcaaagccggactggtagccgagttcctgttgacggatcaggcgctgcttcaactccgtaaacgggtctggagaagcaaacccgattttgtcgattccgatcgttttgctgaaggcaatgacttcttttttcaattcggccgtatccatgattcacctcccccaaaaacaaacaatttatataaaatgaacttaagtttttgcattcagtccgaccaccaatttgcatgacgaggactttttgtacggcaacaagcggcaatatgcgtattgctgccattaaaaacgcgccatcatcaactataaaaatgattgtcacaataaaaacgcagggattctcccccgctctccgggtgaaacactgcgttgcttcttacatacatcaaaaagatatgaacattatattaaagacatccgcttctgtaaagaaacgcggggatccgtccatcaaaaaactgttacccctgttacattttccaccaacagggtaatgcaataaaaaataaacaaaaaggggtgtagaaattgttcggcgaaattataaaactttcgctcggtttttttgcggtgatgaatccgatcgggaatattccaatcttcatttcattaactggtggatattccttaaaggacaaacggaaaaccgcccgcaaagcggtcattgtttcttttatcatactaacggtttttctttttcttggaaaattattgttcgaggtcttcgggattacgattcatgcgtttcgcgttgcaggggggatcttaatcttcgggattgcctacagcctgctgcacgctaaaaatgcaagatcgcaaagcccgcatccgaatgagcggaaagaagttgaagcccgggatgacatctctattacaccgcttgccctcccgatcctggccgggcccgggacgatcgcaaccgtcatggcgcagacgtcttcccattccctgccaaacctggcaagtgttttaatcggctataccattgtgctcgctttaacctttgtattgttttattattcatcttcgattatctctaagctcgggcaaagcggccttaacattataacaaggctgatggggctgattcttgccgtcatggcggttcaaatgatcgcaagcggcatccacgggctgttcccgaagctgtaaaacaatccgcttccatatacggaacatatggatatctgcgtcccgttctggtcccccggttgaaaaaacggtgccggttgcggaaacagcggggttccgcaagccaaaatttgaaaaggcagcacaatacccaaggatcatacgggtatctgagtcgcattccgatcccccgttgaaaaaaccggtgccggttgcggaaacagcggggttccgcaagccaaaatttgaaaaggcagcacaatacccaaggatcatacgggtatctgaaagccctgttccggtttcttggaatgaaaaaagccggtgccatgtgtcggcaccggttttttcagctatgaaaggattcggttaaaaccggaacaatttgttttttccgtgatacaacgccttttaaagtggccgtgttgttttccagcttgacattataggctttttccacaatatccgccgatttgccgagtgcaagtgcgacggaatcgtttgttaaaatatccgttacaacaaacaggaacaaatcaagccctctgtctgtaatctgcgcttggatcgcctgttcaatttccgcctgtttcacgagcacgtcatttgtatcaacggcatttacctgggcaatcaccactttatggccagccatatcaaattctttggagtcaagtgtaatcagctgttccaccgttttgtcacttaaatccgcgccggctttcagcatttcaaggccgtatgtatctgcatccacaccggcaatttcagccagttctttcgctgccttcacatcttcttccgtgcaagtcggggatttaaacaaaagcgagtcggagatgatcgcagaaagcatcaggccagctatttctttactgatttcaaccccattctctttgtaaagtttatttaaaatcgttgctgtacagccgaccggttccgcacggtaatagagcgggtcgctcgtttcaaaattggcgatgcgatggtggtcaatgacttcaaggacccgcacgctgtcaatgtcgtccgcgctttgctggcgttcattatggtccacaagaatgacattttccacttcgtttgcaaccgtttgaacgaggcgcggcgcttccatgtggaatgtttccaatgcgaatttcgtttcattgctcaattctcctaaccggaccgcctccgcgtcaacgcccaattttgtttttaacgctgcataggcaatcgctgaacaaatcgcatccgtatccgggtttttatggccgaaaacaagtactttttccatttctttgctccttttctaaaaaaatatgaaggaaatctggcatagacattcctattataaaacatttcgggaaaatttttaaacattgtccgctggatggatcagaaaaaatcggaacgatccgcttttgcccatcatacgatataccggttgaaagtgaggagggaatccaatgtttgtccatccgtttgatgatcatgccggtttgagaaacacacagcctgacgccgggaaccagcaggcagtatggctcgccaatctaatccaggcaataaacggcgaatatagtgccatcgcctgctacgagcaaatcgcaaggagagccccgtctgctgaagcccgtaacatcattatggaaatccgtgatgatgagattcgccatttccagacattttcgcagttttacacgaacctcacaggcagaaggccgcagccgcaaatcagcgaagcctgcccttccacttacaaaggagggcttgaatttgccgtgaaagacgaacaaaacacggtcgatttttacagagaattggcgcgttccgcaaatagccctgccatgaagcaggcgtttcttgaagcggcaagagacgaacagcatcacgccgtctggtttctttatctgctcatcaatatccgctgaccgtgcgctcaaacacttgccaaaaattcccggatcacccgcacaaattcatggggctcttcaaggtacggctggtgtgagctgttttcaaacatatggaattttgcccccggtatgagccggctataggccctcgttgtttccggcctggcttcatcgtaacgcccgcaggtaaataaggcaggcagcctgatctcatgcaggcggcctgttacgtcaaatgttttcaaattgccggacgggtaaaattctgacggcccccacatcgtcaagtatacttcttcattcggacgggcaaattccgattgcaagacggccggcttttcttcaagacggttgacaaattttttatagaaaactttcattgcctctttgtattccggagaggatgtccgcccctcgcgttctgaacgcgccaaaatttcctggacatcgggcggcagctgtttccggtgttcatcctgatcctctttccactgtggagcgctcaggcatggcccggaaaatataacgctttttacccctgccggctgcttcagcaaatagtttgccgcaagcattgttccccacgaatggccgaggatgtggactttatccaatgcaagtgcctcacgaagccgggcaagctcctctgtgaatctgtcaattgtccagagtaaggggtcatccgggtggtctgatcttccggaaccgagctggtcgtaaaagacaaccggccgttcatccccgagtgcttcaagggcaaaaaacggcatatgtgtcccaccaggcccgccgtgcaatacgataagcggcgttttgcttccggtgcccgttattttgtaaaagacattccctcccgtgactttcacatatccttctgccatattgggttaaccacctttcgctttccctcatccatattttactatacaaagccttttttctggatattttttacccctttgtttacaatacaaaatgctggttaaagcatagctgtagactgtaaagataataaaaagggagttgacaacatgagaaaatacatcaaatggctggccgtgttttgcttgctgcttgcgttaacggcatgcggaaaaaatacggacaaccagaacgcttcaaaatccaatgacttatacagccagatcaaatcaaaaggcgtccttttgatcgggacagaaggaacatatccgccattttctttccataaaaacggaaaattaacaggctacgatattgatgttgcaaaagaagttgcaaaacggctcggattaaaagccgaatttaaagaaacccagtgggatgccatgtttgccgggctcaattccaaacggtttgatatgatcgcaaaccaagtcgggatccgcgcagaccgccagaaaaaatatgatttttccacaccatatacgatttcaaaagccgttgtccttgtacgcaaagacaatacgaacatcaagtcctttgctgatttaaaaggcaaaaaatcagcccaatcgcttacaagcaactttgccactattgccaagaaaaatggtgccaatattgtaagtgtggaaggctttaaccaagcgatccagcttttgacttcaaatcgtgtggatgcaacggtcaatgattccctaacttatctggattacaaaaagcaaaaaccgaatgctgccattaaagttgccgccaccgcaaacgatgccagcaaatccgctcttttgttccggaaacattcaggaaaattgacagacaaagtaaatgatgctttaaaagatatgaaaaaagacggcacactaacaaaaatttcaaagaaatggtttggtgaagatgtttcccaataaccttgcgtttatcagcagcaaccagctgcatttggtgcaaagttcccttctgtcgatgctgaagggagctttgcattatacgattccattaacgattattactttctgtatcggtcttgtgctggcactcgccacggcgctggcacggatttccggcattaaaatactggaatggattgcccgaatctatgtctcagcaatccgcggaaccccgttgcttgtgcaattatttatcattttttacgggctgccgtctgtgcacattaccattggttcttttccagccgccattatcggcttttcgctcaatgtcggcgcgtatgcatcagaaattatcagggcagcgattttgtcgattccaaagggacaatgggaagcagcctattcgatcgggatgaactattcacaggctttgagaagaattgtactcccacaggccgtccgcgtatcggtaccgccactttctaatacgtttatcagtctcgtgaaggatacgtctcttgcttccttgattttggtggccgatctgttccgtaaagcccaggaaattgcctccaccacttatcaatttatgctgctgtatgtcgaagcggcctttttgtactgggtgatttgtttgattctctcaataatccagcaaaaattggaaggccgttttgataaatacatcagcaagtaaggagggacctgtatgattcgaatagaagggttacataaacaattcggcaaccttgaagtgctaaaaggaattgacttaaccattgaaaaagggaaagtgatcgtcatcatcggcccatccggttctggtaaaaccacgctgcttcgctgcatgaatgctcttgaagttccaaatcaaggcagagtacagatcggtgatgtatccgttgacttttcccaacatcccggtaaaaaagaacgcgcggctttgcggcaaaaatccggcatggttttccaacagtacaatcttttcccgcataaaacggttctcgaaaatgtgattgaggggcctatcattgtaaaaaggaaaaaccgccaggatgcagtaaaaaaagctgaaatgctgctggaaaaggtaggcctgcttgataaaaaagatgcgtatccggcaagcctttccggcggtcagcagcagcgcgccgggattgcgcgggcgcttgcgatggagccggaagtaatgctgtttgacgaaccgacatccgcactggacccggaacttgtgagcggcgtgctaaatgtgatgaaggagcttgctgaagaagggatgacaatggccgttgtcacacacgaaatgcggtttgcccgcgaagttgcagacaaggtgattttcatggatggcggtgtcatcctggagcaaggcaaaccggaagaagtattccatcatccaaaaaatgcacggaccaagcaattcctgcagctgattcaaaactaatgaaacggatcaggtttttcgatataaaacgagctgccctctatcaggcagctcgttttatattacttgattttttcagccgaaaaaggggatacggtgtgtgtgtcaacaacagcaaccggcactttttcttttttctttgatgttaagaaggcgtacatggcaccgacaaagacgccgccgccaatcatattgccgagcgttaccacaccaaggttgtgcaaaatgcccacgagtgtaatggtatccgggtatggtgcggcaagtgccagcgagaacagcaccatattggcaatgctgtgttcgtagcctgaaatgacgaagccaaacacgagcagcatcatcgaagcgattttagccccgtctccctttacgtttatcggaacccagaaccctaaacaaacaagccagttacaaagaatcgaacggaaaaacatttgggccgtcgtcaggctaattttcccaccaacaaccgacattaaaaactggctgttatccgaatccgcatagagtccgctgtaatggataaacagcgcgaaaatcgccgcaccgatcaaatttccggcatacgttgccacccagtttgtgagcgcatctttccaagttgtcgctttttttaccgtgctcattgtcatcatcatcgtattgccggtaaaaagctcgccgccgccaaacataataagcacaagcgctgcgccaaaaaatattgaagccataaaggaagtaaccggagacttcgcatcaaaaaacggctcagcaagacggtaacatattataatggcaaaaccgatgaacatacttgccaacgctgcttttgtcacataacgaagcaaggattcttccagatattttttcttatttaatgccatttgaacaacagattcaacggcctcgtacataaacaccatctccaacatgaaaaatgtttaattgtgaatcatatcacaaacaactgcctttctatcatatcccctttttccctgtttgtgtttgtatatattttgaacgtttatgaagcgattacacgagaaaagactattgataggccgtcagagctgccctattttacaagccaaaatccgagaaaatattatatgtatataatattcatatttaacaaaaaagtattgctattaaagtcctttttcattaaaataagttacagaaagagaagatttgaggaaggatatagaaaaaaattaattgaacggaaaattgcggagggtacaaatgctgcaaagtcattcttatcgaatactacataataaactcagtttggtttgtcttctccttattttattcattccttgtgtggaaatcatacaattacttatcaaccaaatccagtttggtgataagtgggatcctgcttttgcatttttcctgacaggctcaagcagagcgcatggagcacaaatcgtcttaatttggtttttgccaatttatttcttgattgctttttcggacgatgccatattggattataaattgggatacagaaatgtagtcgttaataaaatcggaatcaaaaaatactgttcagaaaagatactatataagatgaacttaagtttttgacagctctaatctaacaagcagccggtcaatgacttcttggctcttttggctggcttgtttcataaattccgccacgtgggagcgaatttggtaaaatttgctgaaaaagacgttgtttacgacatcttgctttagccacttccataatccttccactgggttctactcagggctgtatttaggaagaaaaacaaattccattcgtggattttctttcaggaaatccttgataaattgtgattgatgcactttgctgttgtccaaaaccattacaattttaccttgcgggtatttacttaaaatgagttctacaaaacgtctaaaggccaaggaattacttttttcttcttcatagtgcgtaatttcgccggtttcatagtttatggcagcgaacagctttgcacccttatgctggccgtatgttttgatttttcgctgctgtccttttgggaaccagttatactgcagagcctgataagcacggatgaatgcctcatcttcgaataacaggtgatcgatgatcccattctccagttgctgttttagctttaggaaagtgacttctttgaatgctttttgctcttcaggatctgcttttgccaaagtatatgtggcctttgtatagctaaacccaagccggtgtaacattttagaaacgccccttggggtatacgactgttgaaattcacgctggatccaatcggcgattaacgggagcgtccaagtgtattttgcttcgaacccaacttctgcaggggttttgtttataatggtttcggccaactgcttttgttgatcttccgttaatttctcaggtttacctgttggttttttcatttgaaggctggagattcctccttcttcataagcatgacagtaattcatgaccgtttgccgggtacgtcctataatcttagcaatttctggataagtccggccttctaaatgtaacagcacagagagataacgctcataaagatgtttatcccttgtgttttgcatagcgtttcgcaattgttcaagttcttgattcaacattttttctccgccctttttaggatagttacaatctatatacccaaaaaaggaccgaggaagtgagcaaaaatgattaattcgttttatatagattaaaaaaagataagaatggagattacttcattcaacattccggttattacagagtgggaaaacaactgcaagaaggaaaatatagattgtcttttgttgaccatgaaaaaacgcataaccgaaaaccatttgtacaaatcacctcatcagatggtactatccgtcaatcttattcatttgaaaagaaaaaccaaagacaaattaaattgaaccttaaaaatcaggaaatattagaaatccataaaggtttctcaaatgaataccaaaattacgttattttgctacaaccgctgagcaaatcataaattccaaaacgggcgatgaacgtacgatttgtgtgcttgtcgctttgtctaattttacgtaacccctcctaggtaaaccatcagggagccatttgctttgaatctctcgtatggttcttctaaaggggatttttttcgtccctctccaatccaacaggctcatcttccacttgcccagaacctggtatgcattgcgggcggtggttgcaatccggaaaatttgcgccagctgttttttccgtcgcgacatggacgcctgtcttttgaaaaaaggtatagacaaaaaatacctgcaggccggacacttggaaaaagtgcccagcctgcaggtgccagtttactcaaattcccctccgtcttcttccttacatcgctgcttttataatcgcttccacttctttttgtgttggtttgcgcgggtttgtggctgcgcacgcgtcctgcatcgcatgctgggcgaggatttcgatatcttcttctttagccccgagttctttaaagcctttcggaatgttcagctgtgctgccagcctttcaattgctgtaatggctttttccgccgcttcgtcgacgctcaggccatccgtcttctcacccagtgcaacggcaatttctgcaaatctttctttccgcgcaatcagattgaaacggcacacatgcgggagcaaaatcgcattgcaaacgccgtgcggcaagttatagaaaccgccgaactggtgcgcaatcgcgtggacatagcccaaagatgcattattaaacgccatgcctgccaaatactgcgcatataccatttgttcacgcgcttccatatcattgccgtttgcaacagcctttggcaaatattgcggaataatttggatcgctttaatggcgcatgcatctgttaccggtgtggccgcagttgaaacatacgcttccactgcatgggtcaaagcgtcaagccccgttgccgcagttaaagacggcggcatcccgaccattaataatggatcattaatggacaaaaccggtgtcacatgtttatctacaatcgccattttcactttccgactcgtatcggtaataatcgtaaattttgtcatttcgctggcagtcccggctgttgtattaattgcaacgagcggcaccattggtttttcagaacggtccagcccttcataatcatggattttgcccccattggccgcaacgagcccgatcccttttgcacagtcatgcgcgctcccgccgccaagtgaaacgattgaatcgcaattttcttcatgataggtttttaacccgtcttccacatttttgtctgtcggatttggttcagccttcggatagatcgccacttccaggccggcttcttttatataggctgcaattttttcggaataccccagttggtggagcccttcatcggttacaatcagcggtctgcgacacccaagatttttcagcctgtttccaatttcttctgccgtcccctgtccaaacaagtttacggaaggcatttgaaaatcagtacgtaatcctgttaacatctttccccactccttttatgtaactgcttacatgaaaaatataacgcaaacgctttcatctggctgtgccaattttgtgaaatattgagcatgttaccaaatcacaaactctccccaagaaaaataatcatgtgaaaaactgatcaatttgtgttataacacgctttcatcgcatttttctattatatatctacggccaaatgttttgaacattctttgacaactgctttttttggccccaaaatgtgaacgctatcactatctttttaaaatcgaccatgctaaaatgaaagcgtaataagaaatgttcactatttaacaaacaaacatccaattctgaaggcagctcattaataggcttaaaggaggccatttaaaatgactgaacaattactgacaaaagcaacgctctccaaaaaacaatgggaaggcttcaaaggaggaaactggcaaaaagaaatcgatgtaagggactttattctgaaaaatgtaaccccttacgaaggcgatgaaagctttcttgccggcccgactgaagccactttaaaattatgggatcaggtcatggaactgtcgaaacaggaacgcgaaaaaggcggcgtcctggatatggatacgaaaattgtatctaccattacatcgcatggcccgggctatttaaacaaagaacttgaaaaaattgtcggtttccaaaccgataaaccgttcaaacgttcgatgatgccgtttggcggaatccggatggcagaaagtgccttaaaatcttacggctatgaaattgatccggaaatcaaacatatttttacagaatggcggaaaacccataaccaaggtgtattcgatgcctacacaccggaaatcaaagctgcacggcatgccggcattgtaacaggccttccggatgcttacggccgcggccgcattatcggcgactaccggcgcgttgccctttacggtgtagattatttaattgagcaaaagaaaaaagatctcgatttaatcggctgcggcttgatgacagaagaagtcatccgtgaacgtgaagaacattcggaacaaattcgtgcattgcaagaattgaaacaaatggcacaaagctacggattcgatatttccgaaccggcttcaaacgcacacgaagctttccaatggctgtatttcgcgtatctggctgccattaaagaacaaaatggcgcggccatgagtcttgggcgcacatccactttccttgacatttatattgaaagagatttgaaaaacggtgtcctgactgaacgggaagcacaagaactcgtcgaccactttgtcatgaaactccgcctcgtcaaatttgcaaggacggaagattacaatgaactgttcagcggcgacccgacatgggtaacagaatcgatcggcggcatggctttggacggccgtacactcgttacgaaaaactcgttccgcttcctgaacacgcttgataatctcggccctgcgccggaaccgaacctgaccgtgctctggtcgacgaaactgccggataaatggaaacaatattgcgcgaaaatgtcgatcaagacaagcgccatccaatatgaaaacgatgacttaatgcgtgaagaatacggcgatgattatggcattgcctgctgtgtatcggcgatgcggatcggcaaacaaatgcaattcttcggcgcccgtgccaacctggcaaaagctttgctgtatgcgattaacggcggcgttgatgaacggtataaaatgcaagtcgcacctccgttccagccgatcacatcggaatatctcgattacgatgaagtcatggaaaaatacgatcggatgctagactggcttgcaggcgtttatatcaatgctttgaacatcattcattatatgcatgacaaatacagctatgaacggcttgaaatggcattgcatgatcgcaatgtactgcgcacgatggcttgcggcgttgccggcctgtctgttgcagccgactctctaagcgccatcaaatacgcgaaagtaaaagtcatccgtgacgaagacggccttgccgttgactatgaagtcgaaggcgattacccgaaatacggtaacaacgatgaccgcgtcgaccaaattgccgtcaatctcgtcaaatcgtttatgcaaaaactgcaaaaatatccgacttaccggaacgctgtccatacttcttcgatcttgacgattacatcgaacgttgtatacggcaagaaaacaggaagcactccggacggccggaaagcaggcgaacctttcgcacctggtgcaaacccgatgcacggccgcgattcccacggcgcagtcgcatcgttgacatctgttgcgaaactgccttataaatattcgcttgacggcatttccaacactttctcgattgtcccggaagcgctcggacacgaagaagaaacacaggtctccaacctggacggcatgctggacggctatatggcgaaaaaagcgcaccacttaaacgtcaacgtcctgcatcgcgaaacattgctggatgcgatggatcatccggaaaaatatccgcaattgacgatccgtgtatcgggatatgcggtaaacttcatcaaattgacaagggaacaacaacttgaagtcattaaccgcacgttccatgaaatgatgtaaactgattcgggcggcatgcacctgcgtgccccctcccccctattaaacacttaacttatggggaatctatatagaaggatttgattgagatgaacatgacaacgcgcattcattccactgaatcgtttggcacagtcgacgggcctggcatccgctatgtcgtatttacgcaaggctgcccgctgcgctgcaaattttgccacaacccggatacatggaaaatcaatgaaggcaatgaaatgagcgtcgaagagattatgagcgatgtgcgcgattacctgccttttattaaagcttccggcggtggcattacagtgagcggcggcgaaccacttttgcacctcgattttctaatcgaattgtttaaagcgtgcaaagaaattggcgtccatactgccattgacacagcgggcggatgtttctcgcgcagtctccggtttatgggaaaactggatgaattgatgaaatatacaaatcttgtgttattggacatcaagcatattgacccggaaaagcataaatggctgacgggcatgtcaaatgagcatattctcgatttcgcccggtatctcgctgacaagcatattccggtctggatccgccatgtgctcgttcccagcgtcgattcagaagaagatttgcaaaaaacatctgattttatccattcgctgccaaacgttgaaaaaattgaaatccttccgtaccataagttaggcgtctacaaatatgaggcgctcggcatcgactatcccctcaaaggtgtcgaaccgccgacaaaagaacaagttgcacatgcggaacagattttaaaaagggaattgcagtaaagaaaaagcgccggctgtccgccggcacttttttattccgcctaaaagaacgatacaatgttaagaaagtggaaaaacttagagctcctctcccctgaaaaattgccccggggttttttatccttttgctggtaacgcgtcatacggcaagataaacggcaaaatggtcgccttccttcgcctagagcacgtctacctaagcttcgctgatgatccactatcgcccatgcgcaacggccacggcactaggcaaaagtgcatcatcccaaatttccaggattgcctccggagaaagcttttctcaattgcaacagttcatgcgcaagctttcggatgcgtgcctggatatcggcattgatgatttcattgtcctcattaaaatcatcattgtggataaaaacattgcggactgcacaggtggcctttaaaaaggttaacaccggtttcagctggtattcagcaacaagaaaatgtttgtccgagccgccgttcatcacaatgccgcatactttggactgaaaagcatcgcggtgcaaatggtcgagcagatttttcaaagcgcctgtaatggacgcctggtaaattggcgagccaaaaacaaggatatccgcttcaagcattttattaacgaccgcaatcgtatcatcattgtaataagaaagtggaaaccctcttgcaaactccacttcataatcttttaaatcgagcagttcagtttccgcttccggatcttccgctttaattgccataagcacctcatatacaccaatggaggtcttctcaccggtaagcgagccggatatacctaaaattttcaccgtttccacttcctgatgtcatttgaaattttccttaatatatgccgcttcttcagaaggcgtcaaccgccgctccgcttttccgatgttgcctttctggtaagcccaaatctcattatgggccttcaccgcattgctgaaatcgccttttttccacggttttaatatactgagcagcatatcctgcagttctgtatccgcaaaagtttgattgctaattgccgaatacagggcgtccaccttttcttttgtgatttcggaagctccccatttttcatttgccgccactttttgatgcgtcatattatgtacttcctgcaccaatgcttcttcgctcatgcttttgtatgccgaaagtttgcgctcaggcgtcttctggcggaagctttcctgtataaccgcttttgcagccgtctcttcctctgcagccggttttttcgaatgtgctgcctccgttgcaatcgcttctcctttgttaaagtaaaaataagtgacacctgcaataaacataaacacagcaatccccatcccaacgacaaaccgttgaaacacagcatctccccctttgcttatcatacgaaattcgtgctgccccgtaaaaaatcctgctttatcattgtattaatgcagcgaaaaaattttaccggaaattggcggaattccgtttttcttaataaacatcccgttttgtaaacacaacaaaagaaaccacgagcgagagaaaaagccacacaagcagcacagcaaccgaaaatccgagcgtcatgcctgcaacaggcgggcttgtaccattgagataatttgtcagctgcaaattcaccataaacaaatattttgcgcttggccaagccgataccatgttggtcaaaatcgcgccggcaatcaatgaggataacataattcccattacggcggccgtgctgcgcaacaggacagaaagcataaacgtgaggctgcctgaaacgacgcagacaaaccaggcaaggccgaacgccatgagcaaatatttccattgcgggacagcatgcacatgtgcagtaaggagctcgtccccttttatcgtaaaaccggtaagcattggcatgttccagccgcggtagccgaatactattccggaaatggcataggtaaaaacggctgtgcacagcaaaataaacgaaacggacagcagcatggcaatgtacttgctaagcaggatgcgccatcttttcacagggcgcgtcagcaataatttgattgtcccgctgcccgcctcagcagacacaatatcgcttgccgccaccatgacgaacagtggcaaaagcatgccgatcgcattttcaataaatacccgcataaacgtcggggcgcccggcgcgttcggattgatgttgtggttgagataatattgttcctggctcaatgtgatacgcaaatattttttaaaatcatcagaaaggcttgccgatccgagccggttttgcgtatcgacaatttgtttctggagcttaacccgccagtcggttgtcccgattttttcctgcagcgctttcgattctttgtactgcgcgtaggtaaaaatgggaacaaggcaggcgataatcagcataatgacaagaatccgctttttcttccaaagcttcaactgttcattgtatataagttggatcattttttcctgccccctgtcagttccaaaaacaaatcttcaagcgccggcagcacggccttcatttctttcaccctgaccccgttttgaacgagcatctcgttccataaagcatttttttcttcatcataaggggtcacaaggaggccgtcttccccttctgccacctgtgtctccgcctgaagcaaggtgcgtgctttctctattggcgcaactttccaaaaggtacgcgctttttcggaaagcagctcgtgtacattcccggtccgaatcacctggccgttatggataatggccactttgtcgcacatcagctgcacttcgcttaacaaatgcgaagaaacgaggacgcttaaatgcgctttttcggcaagcgaccggataaattcgcgcatttcccggatgcctgccgggtcaagcccgtttgtcggttcatcaagaatcaaaagcttcgggtttccaaggagcgcctgggcaatgccaagcctttgccgcatgccgagagagtatgtttttactttatcatggatccggccagttaagccaacgagcgccgccacttcatccagcctgtttctcggaatggacggatccatccgtgcaaaataggcaagattttcatagccggtcaaaaacgggtacatctccggattttcgacaatgcaaccgagatttttcatggcttccgtaaactcggtccgtacgttttttccgccgatcaaaatttttcccgaagtcgggcggatcagacctgtcagcatccgaatcgttgttgtcttccctgccccgttcggcccgagaaatccgaatacctctcccggcatcacttcaaaactgatgcctttgatgatttctttcctgccaatttttttatggacatcgataaccttaagtgcgggaatcgtcgtcatttcgctttctcctcccgataatggatcagggaagcaacacgctctccgatcagttgataaccggccgtattcggatggaatttgtcactgtataaatagtcgtttacattttgttcaaaaaggtcaaacgtcggcacatagatgacttttggaaagtcagacgcgacagaagcagaatcaaagttccattttctgacgatcgcagaggtcgttttcgcctcggacaaatcgataaaaggattatacagcccgacatgatagacgattgccgttttgttcaccgcccgaattcctgcatagatctgttttaaattggccaaataaggcttttccagcttttcgatataggcggtattcaaatggtcaagcgcctctccgcccgcaaacaaatcattgccgccgatggtcagcaaaatgatatccgcgctcttgagttcgcgtttgatctgcggttgtttgagctgttcaagcagcccgcttgatgtaagccctttgatgccattgttttggagtagaacagccttcttcgtttttttctttaaacgatccgcagcatcacccgcatatccctttcctgctgtatctcccgttccccttgtgagtgagtcgccgattgctgtaatcgtgatttgtttcgtaccacccgcttttgacgtgttattgccggttctggcagtttccgtctttacgcctgttgctttcgtctgctggtcttcaaacaccatccacaggccggccagaaacaacaaggctgacacggcagaaacaatagagatggcggaaattaaatgctttttcatttcgctattcctttctttcctgtttataacttaaaggatagcaaaggaagccgactttttaaaatcgcgtgctccaaataaatgcacaaggtccattctaaaaaaagcgttgtccggtttccaggtaacaccctgcagaaatgtttgattgctgcgggctctctcccaaaatacagcgctgatgggttttacggagacgaaacagtgcaagttgccaagtactgtaaaggaaagcggatatagaattatgaaccggcgacagcgggattggctggtgttgcccaacagtgtttaaaaagggatcaaaaagcgtggaaaaagttttcaaaaaaccataataagattaaagaattttgtaagaataatgaatatccaacaaaataaaaaaactgctggtatatcgtggattctgggagttttttacaagtaaatcgcaaataaagccgccaaaacagccataacaaagtaatcattactatccattttcgtaccgtttttaacaaaaacacttaaagcccaatgcaatattgttccatcagccgtcttagaaacgaattttttgccgatattgtaatacagcactttgaataaggcaaatgcaattgaaagaaacaaataaagcaagataaacttaccaaaaaacaaaagcattgccgtcactcctatatttagtattcttcaatcaataacttaattttaccaaaaacgtctataagagaaaaagggacatttgtaatggctttcaataatttttgcgcaaattttacacaaaggtaaacaaaaatcttgataaattgttggtttagaagatacattcgacacccgaccaccggtacgcgctcttttcgcgtcaaaatcaattatgatcagggacattgcttttggcgacacatgaaaaagtaatgtttagtccaacttatataaaaagatgatgttttctttgacaaaaaagcttatcaaattagtgatgaaattttcattcaatgtagataatatacataggatctagtataatatagatagtccgttaattagtagacagcttaaaggaataagtaggtaaattggaatatcatgtataaaattggaactcaaaaaagaattttatgtaccttaaacaactggcaggaggagaaatcgtccctgaagatcaagacagcaataatagaacaaagtcccttaaaaataactgaaaattctccaacatcaacccaacactgtaattattttatagaaagaatatggaatgaaaagcgattttcaaatttatgcaaaggaggtagaccggtgctaaatacgcataatgacataaagcaaacatattatgcagaaatcaaagaaaagaagattagttcttatggagcttatgcaaaaaagggaaagggagtcaaacacgagataggaaaaatttattttgccagtgacttattaagagggaaagaaaaaaagttatataaaaaatcaggaaaggtaaaggtgtacaatatgtttacaagtttaatgacctacgaagatttaaaatcgcatccgaaagaacgacaaacggaaattttaacgaaatggagggagacctattcagagaatgaaataatagaagcattaggtattgaagaagaggtgtactatcaattgttgactgatttaggacttgaaatgaagaagaaacggacaattccgcactcaaaaccggacgctgatccaaaccaagtgattccatttaatgatttaaaaaagcttccaaaaaaagatcaatggctgcttatatccgaatatacagaaaaatggaacgcccaatcaattgcaaaaatttgggggaaacgagattcttccgttcataattataaacacaatctgaaaaaattagccctcaaaaacgggtggatagatgaatataagaaagataaagcacaggagaatataaaagattttacgccggctgctgtggaatccggacaagaaccagctggaaatgcaggggatgaacgtgttgaccaactgatgagtgagtttaaggaaatgaaaatgttgattaataactttttttcgagtagtcaggctacaaggaggggaagcattgacccaaacgatcctaagaccattatccgggaacatcgcgaagcgtccaagtccgaacttgtattccgggcgagcccggaatacaaaatcttatattcacttgtcaatgagcagcagaatgaactggaaattgacatccactttggatttaaacttattatacgaggaggtttttgcatggatcattatgccagccgtttggagggcgattatgccgggatccaaaagccggtaacgcaaacaggagaattgcaacgaaaggaaaaaatcgcatacggcgcaggggatatcgggtataattttctgtttgacctcgggcaaatctatttgcttaagttttatacggatacgctcgggcttccggcttccattgcaggaatggtatttttagtgacaaaaatttgggacgctttttcggattttacgattggtacggttgtggaccaccggaaaaaaatcgggccaaaggggaaattccgccctttcattctgtataccgcagttccgctggcgctgatgacggtgacgaattttctttcaccggatttttcattaaacggaaaagtgatttgggcctttgctacatacatggctttcggcaccatctacagcatttccagcataccatacggttcaatggccccggcaatgacgaaaaaagccaatgaacgggctgaattgtccgctttcaggcaagccggcgccaatcttggattgctcattacaacagtcagttttatgccggttgtcctcctgttcgacaatccgaaaatcggatatccggtggcggctgcgatttttgcaacggccggtatattgctgcaaatctattcttataagcatataaaagagcgccatgtcgaactggaaccgaaaaaaacaaaccactcggttaaagacagctacaaggcgcttgtcaaaaacggcccccttttcattgtcagtctggtcaatttatttaccatttcagcctacaatgtgaaactggccgtccaggtgtattactgccagtatgtactgcacaatgtcaccgtcgtttcctatatgggatttttcagcatgggctgcgcatttttcgggattgcccttgccccttttgctcagcgaaaaatcgggaaaaagtacacgtatatgttcggctgtgccatttgggctgttgccgatctgcttgctttgttttttgcccataatgccgtcctctttattgtatttgcctgcctcgcctttttcggaaacgcttttgtcaacagcctgaactgggcattgatttccgactgtgtggaatacggggaatggaaaaccggaaagcggacggaaggcattgtctactctttttttacattctttcgcaaattgtcgcaggctgtcgccgggtttattcccgggtttgtgctgggcatttccggatatgtgccgaatgccgtccagtctgcaagcgccattttcggtatcaaagcgcttatgttcatctatccggcagcactgtccattttaaccattgttgtattcggctttttctaccgcctgacggaaaagaaatataaagaaatcgtggcggagatgaacagcaggtaatgcaggtcaagggagcagtttcaacaagcaaacgtccaattttggaatgaacaaacagggaattggaaagaaaaaatgctgatttggaaagaaaaatacagattttggaacaaaaaggaaagtccggaaagcaagatttcaagtttaaatgaattgttcgggaggtaacaggcaccctcccgaatttggagtgaaaagccgcctctttccaatatacaacgcaaacttttcatctgcaaagtctgcgttgtatattggataaaaatcacataaaactgtcgtcaatgagaccgttctccagttcctttttcaacgctggaaaagtgacttctttgaactccttgttcgtccggatcagcttttgccaaagtatacgttgccttagtgtagctgaatccaagcctgtgtaacatcttagaaacacccttgggagtaaaagactgctgaaactcttgttgaatccagtcggcaattaattggagcgtccaagtgtattttgcttcgaaaccgacttctgcaggtgttttattcacgatggtatcggccaactgtttctgttgttctttacttaacttttcgggtttacctgttgtttttttcatttgtagcccggaaattccaccttcttcataagaatgaaagtatgccataaccgtctgccgattacgtcctataatcttagcgatatccatataagtagggcttgctgaacgaatccggttctgaatttgtacccaatttgtctgcaaactccatcgcaaaatatatgcgaaaatgcgtgagtttgtcttctccggacgttgaatcggctttcgcgtgcaggcatttccctggatttgttgtaaaacctttgcatttaaatggttgccaaagctgtcagcatccttgccaaatctaggaatttcgcttattcagcaagccctaagtatggccttctaggtgtaatagcacagaaaggtaacgctcataaagacgtttatcttttgtatttttcattgcatttcgtaaggattcaatttcttgttttaccattttttctccatcctttttggtatcattacagactttatacccgaaaaaggaccaaaaaattgagcaaagatgattagttcatcttatataacttaagttttatcaatggacggttcaaagagaactcgctgtggaaatttcaaccggagttttaaaaggcgcagcatttggcctatatgttaaaagcatttccgaggaacaatgggatatgcgaatgccgggcattttttcattttaatggatatagactagtctacggtttccgagtttagaaaaagaagaaggtgaattccaaaatctttctggttttccagaataccattataatagagaaataagcaatgatcaggagaggatgttaacgttgagtgaatatcacattccggagaaggtccagatatttggaaaagatattcggaaagagcaattgaagtatcatcataagagaacagctgtaacaaaggaatttactttcgatgctgcccatcatttgcatttgtatgaaggaaaatgcaaaagcctgcacggccatacatacaaagtaaaaataacatgcagtgcgtacttaaatgaaattggcatcagcatagactttggcgatctgaaaaagatatttcaggaagcggttgaggaaaaactggatcaccaatatttaaacaacgttcttccgccaatgaacaccactgcggaaaatatggtggtctggatgtgggaagagattgaaaaccggcttaaccagcaaaaagattacaaagaccggggagcgagattggaagaactggtactctatgaaacaccaaaaagttatgcaacgatgaaacgggaatggatggaggaagaaacagatggtaagtaaaattccggtgatcgaaatatttggtccaacgatacaaggggaaggtatggtcatcggaaagaaaaccatgtttgtccgcacggccgggtgtgattatgcctgcagctggtgtgattctgcttttacctggaacggggaggaaaaaggccggattgtgctgatgacggcagaggagatcttccagaagctgaaagaaacaggaggagaaaactttagccatgtcacgatttcgggaggcaatccacttttgttgaaaggccttggtgaactggttgatttgcttaaaacccatcaaatccgtacagcagttgagacacagggatcgcgctggcaaaattggcttccggacgttaatgatgtgaccatttcgccaaagccgccgagttccggcatgcacacagattttgagactttggataggatgattgaacagttaacactggcgggaagccatttttgcttaaaagttgtcgttttcgacgagaaggattttgattacgccaaaaagatccataaacgctatcctgctgttcccttctatttacaagtcggcaatccggatattgctttgcccgaccgggatgcgttagcgaaaatgctgatcggaagatacgaatggctggtgaatctaaccttgcaggcagaagaaatgaatgatgcttatgtccttccgcagctgcatgcattggtgtgggggaacaagcggggcgtataaaaaagatgttatttttattataggatgcaaaaaaacggtgagacacgattaatggcggtgtctcgccgtttttttgtcagcggcttcattcaaatgttaaggagtcgcggaaaaagaaagtccttccttaacctagagcctgtctacgttaagaaagcaagcaaaaacgaaggccttccttaacataaaatgcatctatattaagtaagcgtgaaaaaacgaagtcctttcttcacatagaggacgtctacgttaaggaagtgcggaaaaaagacggccttttttcacctagagcccgtctacgttaaggaagcaagcaaaaacagagtccttccttaacctagaggacgtctacgttaaggaagcgcggaaaaaagaaggtcttccttcacatagaaggcgtctacattaagaaagcaagaaaaaacaaagttcttccttaacctagagcgcgtctacgttaaggaagcgtgaaaaaacgaagtcctttcttcacctagagcccgtctatgttaaggaagcaagtaaaaacgaaggccttccttcacatagcccccgcctatgttaagaaaccgcgaaaaaacgaaggtccttcttaacatagaacgcatcatcctcttcttgttgctttcgcttttcatcatgtgtccttgtcatcggtatcactttacctgtcttcgcaggccgtcccctctttttctcacatatgctggcttgcggccggttttgtgtcgggattgactgcctttttgtctttcatccggctgtagatgtttgcgagcaacgaaccggacaaattgtgccagacgctgaaaatcgcgctcgggacggcggcaagcggggaaaaatgcgcggtggccagcgcaacgccgagcccggaattttgcatgccgacttccatcgaaaccgctttttgcttggcaaggtccatcccgcacaaacgggcgaagaaaaagccgatgataaagccaagcaagttatgcaaaataacgacagcaaaaacgagtaaagccgtttgtgcgattttttcggcgcttccggcgaccactcccgctacaatcagcacgatcgccacaaccgagacaagcggcatcgcctttgcaccggcgcgcgcctgtttgccgaaaaaccttttcacgataaacctgagcaaaagcggcacaatgattacttggacaactgaaaggaataaagacaatacactgacatgcacccatttgctggcaaatagcaagattaaaagcggtgtgacaatcggcgcaagaatcgtggacacggaagcgatcgcaacagcaagcgccacatttccacgcgcgagaaacaccatcacgttcgaagccgtgccgctcgggcagcagccgacaaggatgacgccgattgcaatatctttcggcaagttgagcccgactgcaagcagaaaagcgataagcggcatgatgacaaaatggccgatcacgccgagcgccacctcgagcggttttttaaaaacttctttaaaatctgataattcaagcgtcagccccatgccaaacatgacaattcccaataacggtacgatataattcccaatccacgcaaaatgctggggtaaaaaataagcgatgactgcaaaaatcagcacccatacggtgaacgtttttcctgcaaacgcgctgattttttctaaagttgccatgtgaagacctccaaatataaattgttttctaaaatgatctgacaaaataaattaaggcagttatttcaatattttgggatttatttagatcattcactcccgaaagcgtttttttgccaaaaaaaacagcgcaggcccagtcctgcgctgtttacaacctattccgtgtttttcatgcatccttcgtttttttcatggccagcactttgtcgacatccggtgtgacataaacggtttgctggttctcgtaaatgacaaacccgggttttgcgccgttcggttttttcacgtagcgcacttttgtataatcgaccgggacggaagcggactggcgcgctttgctgaaataagcggcaagtgttgcggcttccaaaatcgtttccggcgccgggtttttgctgcggatgacaacatgcgacccgggaatgtcttttgtgtgaagccagatttcatcgcgggcggcgacccggtttgtcaaataatcgttttgcttgttgttctttccaacaagcatttccgtaccatccgatgcctcgtatttttcgagggcgattttgtttgcatttttccgccggacgcggatgtgccgttttttcaaataaccttcttcttccagctcttcgcggatttccccgatatctttcggggaggccgtttcaagctgctggaggaggttttcaaaatacagcacttcatcccgagcctttttgatctgttcacgcacggcgacttgtgcatgctttgctttctggtagcgagaaaaatagctttgcgcattttccgcaggggttttcagcggatcaagcggaatttcaaccattgccccgtcctcatcgtaatagttttgcactttcactttgtccatgcctttttttacggcgtacaaattggctgtcaatagttcgccgtacagctggaactgttcggcgttttgcgcttccgcaagcgtggcttccagctttttgattttgctttcgtttttctccagttcatttttcacataccgctcaagatcgtggcctttttgcttgacgcggtcacgttcggctttaccggcataaaaacggtcaagcagcgcgcttaaagtcggaaaagttttgacttcgccttcaagagacgtaagcgggatcatgtagaacgattctttttgcgtgccaatgatcatcactggctggaggtcaaactttttaatcggctccataacagacaaaaacgcgtccgtgactgcttccggattcgaaaacttcgcccggtgcatgatttctttcgccaaaagaggagagacgccggcaaattgcgcgacaatctgcttgtccattttcccgctgttccagtcaagcgctgctgtgacatcctcttttgccgcttcaagtgggttccgtttgtgctgctcggggggcataacatattcatgcccggggagaatcgtccggtacgtattaacagccggcgggacatgtttgatgctgtccatgatcaggttccgctctttgtcgaccaagatgatattgctgtggcggcccatgatttccacgtacagctgtttaaaggaaatatccccgatttcgttccggcttttgatgtcaaagacaacaacacggtcaaggccggcctggtgaatatcctcgatcacggcaccttccagatgttttcttaaaagcatgcaaaacatcggcgggtcctgcgggttgtcaaacggttcatccgtcagctgaatgcgcgcataggccgggtgtgctgacaaaagcagccgcctgttttttccgtttgcacgcaccacaaggaccagttcattctggtacggctggtggattctgttaatccgcccaccttttatcgtatcaacaagttcttttaccatcgctcttgtaaataatccgtcaaatgacatatcgcattcctcaattctttcgcgcatgcataaagcattgcgtcagtcgttggcatgttaaattatatcatttttttggacagggctgaatatgttgctattaagacaataatgggcagaagcaggggagagtgtattttcatgatgtttcacgaaatgagtgaaaaagaagtagaacaggaattcggaactgatctggaaaaagggctcaccgaaaaagaagcggaaaaaagaatcaggcagtacggctttaatgaactggaagaggcggaaaaggaatctgcccttatgctctttctcagccagtttaaagattttatgacgctcgtcctgcttgccgcaaccgtgatttccggatttttaggcgaatatgtcgacgcggtcgccatcatcgccattgtattgattaacgggtttctcggcttttttcaggagcggcgggccgagaaatcgcttgaagcattaaaagaactttccgcaccgcaagtcaatgtacgaagaaacgggcgatgggtaaaaatcccttccaaagaagtgacgcttggtgatattttaaaatttgaaagcggggaccgggttggcgccgatgtccggattgtaaaggccaataatcttgaaattgaagagtcggcgttaaccggagagtccatcccttcccagaaatcaacggaaccgattcctgtggaaaatgcgggccttggcgatttgcataatatggcgtttatggggacaatggtaacgcgcggcaacggcatcggcattgtcaccggcatcgggatgcagacggcaatgggggaaattgccgatatgattcaaaacgccgaagcgatggcgacccctttgcaaagaaggctcgagcaactgggaaaaattttaatcgtggtggcgctgcttttaaccctccttgttgttcttgtcggcgtctggcacgggcatgacttgtattccatgtttctggcgggggtttcgctcgcggttgcggcgattccggaaggcctgccggcgattgtgacgatcgcattatcgctcggtgtccagcgcatgatccggaaaaacgcgatcgtccggaaactgccggctgtggaaacgcttggctgtgcgtctgtcatctgctcggataaaaccggcacaatgacgcaaaacaaaatgacagtcactcatttatggagcgggggaaagacgtggaaagtgtccgggacgggctatgagccgaaagggatttttacggacaatggcgcggaaatccacccgttaaaggaaaaaagcgtctaccagctgttgacgttcgggctattatgcaaccatgccgaattgaaagtgaaaaacaaagaatatatcatagacggcgacccgacggaaggcgcgctcctcgtttctgccctgaaggccggtttaacgagggaattactgctgaaagattttacgattgaacaggaatttccatttgattcaacgcggaaaatgatgagcatggtgatccgtgacaaacacggcaaacggtttgtgatcacaaaaggcgcgccggatgtgctgctcggggtaagccggtcggtgctctggaacggcagggaacaatcgtttgatccggaaacacggagaaaagtagagaaagcggtcgaatctttggctgcccaggcgctccggacgatcgccatcgcattcaagccgcttgcagcaggcgaaacggcaaaaaacgaacaagaggcggagaaaaatttgatttttctcggcgtccagggaatgatcgatccgccgcggccggaagtcagacaagccattaaagaatgtaaggaagcgggcatccggacggtgatgattacgggcgaccatgctgtgaccgcaaaagcaattgcaagacagctcgggattttgcgcacaagccgtgaaaaagtggtggacggcgcgatgctgaacgaactgacggtggatgagctggaagacgtgattgacgaagtttccgtatttgcacgtgtatcgccggatcataaactgaaaatcgtcaaagctttccaaaaccgcggggcagtcgtcgccatgacaggagacggcatcaatgacgcaccggccataaaaacggccgatatcggcatctcgatgggcataaccggaaccgatgtcgcaaaagaagcgtcctcgctcattttgctcgatgacaattttgcgacgattaaagcggcgatccaggaaggccgcaatatttacgaaaatatccggaaattcatccgttacctgctcgcttccaatgtcggcgaaattctggtcatgctgtttgcgatgcttttgtccctgccgcttcccgtcgttcccatccaaattctgtgggtcaatctcgtaacggatgggctgccggcgatggcgctcggcctcgaccagccggaagaagatgtgatgaagcggaatccgcgccatccgcgtgaaggggtgtttgcgcgcgggctcggctggaaagtgatttcgcgcggttttctgatcggaattgcgacattggccgcttttgtgaccgtatattaccagcatcctgaccggcttccttatgcccaaacgattgcatttgcaacgcttgtccttgctcagctgatccatgtgtttgactgccgcagcgaacgctcggtgcttgcacgcaacccgtttggaaacgtctatcttgtgcttgctgttttgtcatcggtgttgcttatgcttgccgtgatttatgttccggccctccagccggttttccatacgcttccgattttgccgaaagactggctgctcgtcctctgcatgagtgcgattccgacatttttgcttgcggggacctattatttaagaaaaaaaccttaaattatgctataatcttaaaagtaataggggatcctctattactttttcttttggcgaagtttcccccggcgctccggttaagattttctttcctaattgaacggggcgcggtataatctccgtaaaagcttttttgattgagccaggaaaaggcgcgatgaaagccgtgaaggttaaaaccggcgcgacggtagatgtaagaagagattgggcgtgagaagatggtcttaagcatgacgggctatggcagaggccgccgaaagacgcagcagttcagtgtgacagttgagatcaagtctgtcaaccatcgcttttgcgaatatcagatcaggatgccgaagcagcttgtcaaagtggaagaagagttgaaaaaaatcatcgggaactatgtgcagcggggtcgtattgacgtgtttgtcaccattgccggtgaagggcttgtcaaacgcaggctgcgggtcgactgggatttgctggacgaataccaccggtttttaagccggatccgtgagcaatacggaattgaatcaggttttggcattcgcgagttattaaaccgcgaagatttagttacaatagaagaaatagaggaagataatgaagaaatcctcacccttgtcttggaagcctgcaaagaggcggccgggcagttgcggcttatgcgcgaaaaagaaggttccctgctcaaagccgatttggaaaaacatctccaaacgatttcaaagcaggtggacgatatcaaaacagaggcgcagtcgctcgtttctacataccgattcaaacttgaaaagcggatgcaggagctatcaggcggccggctggatgaagcgaggctcgtccaggaagcggcgctgtttgccgacaaatccgatatccatgaagaagtaacaaggcttgagagccacttgattcaatttggcgaaacgttggcgcttgatgagccaattggcagaaaactggatttcatgatccaggagatgaacagggaagtgaacacgatcggatcaaaagcaaatgcttccggtatttcaacagccgttgttgagctcaaaacggtccttgagaagatgcgcgagcaagtgcagaatatagaatgattcgcgcgaagtcaattgtatgcgagcgggagaggatgcaggtggtaaaactcattaatatcggctttggcaatatcatttcggcaaaccgcatcatttccattgtaagcccggaatcagcgccgattaagcggctcattcaggatgcacgcgagcgtggcactttaatcgatgcgacatacggcagaaaaacccgggcagtggtaacgatggacagcggccatgtgattctctccgcagttcagccggaaacagtggcgcaccgtgttacggacggggaaacagatggcgaggaggtatagcgttgaagaaaaaaggattgctcattgtgttatccggtccgtccggtgtcgggaaagggaccgtacggaaagccattttttcgcagccggatacgaaatttgaatattccatctcaatgacgacgagaaaaccgcgggaaggtgaaatcgacggggtggattattttttcaaagaacgcgaagaatttgaagaactgatcaggcagggaaaactgctggagtacgcggaatatgtcggcaattattacgggacacctgtcgattatgtgaaggaaacattggaagcgggaaaagatgtgtttctcgaaattgaagtgcagggcgcacggcaggtccgcgaaaaatttccggacggcttattcatttttcttgcgccgccaagtttgtccgaactggaattgaggattacgcagcgcgggacggaaacagccgaaaggattcgcgaccggatggaaaaagcccgcaaagaaatcgaaatgatgaatttatatgattacgtcgtggaaaatgatacaatagaaaacgcctgcgaaaaaatcaaagccattgtcgtcgcggaacattgccggacgacacgcgttgcgaagctgtataaaaaaattctggaggttgaataagatgctttatccttccattgatgaactattgaaaattatcgattcaaaatattcccttgtcacgatcgcggcaaaacgcgcccgccagctgcaggacgagcataacgaagtacttgaaaaatatgtttccgataaaaatgtcggcaaggcgcttgaagaaatttatgtcggcgtcctccggatcaaacacgatggaacagcttcttaaggcatcctggcgcgatcatacggaaaatcacagagcagggactggcggatatggcgtcagccctttttcttatatttgcttttttgttagaatggtcgtaaggagtttgactgagattttacagggggcatatggatgcttggaaaaaatatactattgtgcgtaaccggcgggattgccgtctttaaagcggctgcgctcacaagcaagctggcgcagtccggcgcacatgtgaaagtcatcatgacggaatccgcctgcaagtttgtggcgccgttaacgtttcaggcgctttcccggaatgaagtgtacaccgatacatttgatgagaaacacccggaaaaaattgcccatattgatcttgcagactgggcggatcttgtcctcgttgcgccggccaccgctaatattattggaaaattggcgaacggaatagcggatgatatggtctcgaccacgattctcgccacgaccgcgccggtatgggtggcgccggcgatgaatgtccatatgtatggccacccggctgtccgccggaacctggaaacgcttggaagcttcggctaccggctgatcgagcctgcggatgggcatctcgcatgcggctataccggaaaaggaagattggaagaaccggagaacatcgtggcgcttttgaaagattttttcagcggtggcggaccaaaaccgttgtccgggaaaacggttttagtgacagccggcccgacgattgaaaaaattgatcctgttcgctttctttcaaaccgttcgtccggaaaaatgggatttgcgcttgccgaagaagcggccaatatgggggcaaacgttttgcttgtcacaagtgtggacaatctgacaccgcccgccgaaacggaaatcatcaaagcggagagcgcagaggagatgtatcatgcggttatgggccgctacaaagaagcggatatcatcattaaaagcgcagccgtggcagactacacgccggtccgtgtttttgataaaaaaatgaaaaaacagccgggcaacctgacgctggaattgaaacggacaaaagatattttaaaagaactcggcgaaaggccggacaagccttttctcgtcggctttgccgcggaaaccgataatctcgaaaactatgcgcgcgacaaaatggaacggaagcgtgcggatataattgttgccaatgatgtgagccgggaaggcgccggctttgccggtgataccaatatcgtgaccatttttaaacgcgacggctcgaaacgggaactcccgctgctttccaagcatgaggcggcaagggaaattttgcgcgaaatctgccgcgagatcgaaaagggcgaaaagaaatgaagattgcaaatgtgattgtcgatataccggcaatgcagacagataaatattttgattaccggatcccggaaaaatgggaaacggccattcagccgggaatgcgcgtcattgtcccgttcggcccgcgtacgatccagggatttgttgcgggcataaaagaccgttcagaagtgaagaacttgcgtgaaatcattgcgccgcaggatttggccccggttttgaatgcggagctgcttgcgctcggggactggcttgcgaaggaaacgctttgcctgaaaatctccgcttaccaggcgatgctgccggctgcgatgaaggcaaaatatgaaaaacgcatcaaaaggcaggacgggggcgccaacccttttcttgacgaagtgtttaagggtcatgacgaaatcagctggaaagaagcacagcaaaagggctttctgccgtttctgcaaaaagaagcgaaaaacggatcggtggaagtcgtgtatgaagtcaaaagcaaagccaataagaaaacggtccggcttattttctgcccgctgtccaaagacgagcttgaaaaacggatggaagaagtgccgaaaaatgcaccgaagcaaaagcaggtgctgcaatttttcctggaaaatccggatgctaagatggcttctcccgaactggcagaaacagccggcgtatcgcgggcggttatcaaaacattgcttgaaaaaggatggttggaagaaaaacaggaagaatcgtaccgcgatccgtatgccggccgccaatttcaaaagagcgtgccacatgctttaactgcggagcagaagcaggcaatcggcccggtcctttccgctgtccgcgaaaacagaaatgaaacgtttttgctttttggcgtaaccggtagcggaaaaacggaaatttatctccagtcgatacaggaagtgctgaaccagggaaaagaggcgattgtccttgtgccggaaatttctcttacgccgcaaatggtgaaccgttttaaaagccgtttcggcaaagacgtggcggttttgcacagcggcttatcggtcggcgaaaaatacgatgaatggcggaaaattacccgcaaagaagcgaaagtggtcgtcggggcgcggtcggcgatttttgccccgcttgaaaatcttggcatcattattattgatgaagaacatgaaaacagctacaaacaggaggacaacccgcgctaccatgcgagggacgtcgcccttttccggagcaaaaaccaccattgcccggtcatactcggcagcgccaccccgtcgcttgaatcatttgcccgcgcgcaaaaaggggtctatactttgctgaaaatgggaaaacggatgaacaaccacccgcttcccgaagtttcaattgtcgatatgcgcgaagaattgcgcgcaggcaaccgttccatgttctcaagagagctttttgaaaaattgaaagaccgtctggagaaaaaacagcaaactgtgctgctgctgaataaaaggggatactcttcctttgtcatgtgccgggactgcgggtatgtgcagcaatgcccgaactgtgatatctcgcttacctatcaccgctctacaaacgaaatgaaatgccattactgcggttacgagacgtttgtgcccgcaacatgcccggaatgcgggagttcccatattcgttatttcggaacagggacgcagaaagtggaagaggaactggggcggctgttgcccgaagcacacgtgatccggatggatgtcgatacaaccggccacaaaggggcacatgaacggatgctgcaaagctttgcaaacggggaagccgatattttgctcgggacgcagatgattgcaaaagggctcgatttcccaaatattacgcttgtcggcgtgctgaatgcggacacgatgctccatttgcccgatttcagggcgtctgaaaaaacgtttcagcttttaacgcaagtaagcgggcgcgcggggcggcaccagctggaaggcgaggttgttgtccaaacctatacccccgaacattacagcatccaatttgcaggggaacaggactatgaacgcttttaccgccaggaaatgagaatgcggaaagtgggcgcctatcctcctttttactatctcaccctgattacggtcagccatgaaaatgtgatgaaagccatgtccgcagccgaaaaaatcgcaggttttatgcggaaccgggtgtcgggcggaagcgtgattttaggcccttcggcatgcccggtaccccgtgtgaaaaatagatatcgttaccaatgtctgataaaatacaaacgggaaccgcggctcaatgaaacattatctgttttgctggaacatttccagcaccagattgcctcggaaggattaagcatcgcggtcgatgtcaatcctaatatgatgatgtaacaggaacgagtgattcgaaatgatggagattgtaaaatatcctgccgctattttggaggaaaaatgcaaacgggtcacggcattcggcccgtctttaaaagcggtactggatgaaatgtatgaaacgatgcttgaagcggacggggtcggccttgccgccccgcaagtcggcatcaaccagcaaatcgccgttgtcgataccggggatgaaacaggccggattgacctcatcaatccgaaaatcgtaacaaggcgcggggaacagacggatgtcgaaggctgcctgagttttcccggcgtttatgggacggtttcgcgcgcccattatgtgaaagtaaaagcacaggatgcaaacggaagggcgttcaccattgaagcggaagatttccttgcccgcgctttgcagcatgaaatcgaccatctgcacggcgttttgtttacgtccaaaatcattgattatgtggatgaggaagacttggtttttgaggaggccgatgccgaatgacgaaagtggtgtttttgggaacgccggattttgccgtgccggttttacagactttgatccgcgacgggtacgaggtcattggcgttgtgacgcagccggataggccggttggcagaaaacaggttttaacccctccgcctgtaaaacgggagacggaaaagcacggcattccggtttttcagccggaaaaattgcgcgagccggaaagcctcgcccgtattttggcgctcaaaccggatgttgtggttacatgcgcatacgggcagattttgccgaaagcattgcttgatgcgcccccgttcggctgcatcaatgtccatgcgtcactgctgccggaactgcgtggcggggcgccgatccatacggctattttacaagggaagaaaaagaccggcgtcaccattatgtacatggcggaaaaactcgatgccggcgacattttcagccagcgggaagtcgaaattgaagaaaccgatgatgccggcaccctccatgacaagctgagcaaagcgggcgctgtgcttttatccgaaacgcttccgaaaatcttggcaaaagaagtgacgccggtgccgcaggatgaacagaaggcgacgtttgcccacaatattacgcgcagccaggaaaaaatcgattggaaaaaaccgggggaagtcatttacaaccaaatcagggggctgtgcccgtggccggttgcctacaccgtgcttggcggaaagacgtttaaaatatggaaaagcgaaaaagtgccgctttctgagcaggcggagccgggcaccatcgtcacgatagaaaaagacgggatcgtggtcgcaacgggcaacacaaccggcattaaagtgacggaactgcaacctgccgggaagaaacggatggcggttgcacaatttttaaacggttcagcgggcggccttgcacccggaatgaaatttggagatgaagatgagtaaagatcggaaaaatgtccgtgaagcggcgcttgaacttttggaggcagtggagaaaaacgagtcgtacagcaatttgctgcttgaccgctatattgaaaaataccggttccacggtcctgaccgggcgctgcttacggaaatcacttatggcacgttgcagagaaaacagacactggactattttctcgccccgtttttgcgcaaaaaaattgaaaattgggtgcggattttgttgcgcttgtctttatatcaaatggtatacttagataaaatccctgaccgcgcgattatttttgaagcggtggagatcgccaaaaaacggggccaccgcgggatttccggaatggtcaacggcgttttgcgcgccatccagcgcggggggctcagaagtttaaaggaaatagaagacccgcttgaaagattatcggtggcaacgagccatccgcactggcttgtggcaagatgggcggaagcttacggctataaaacgacgaaagaaatgtgtgaagcaaacctgattccgccgttacagacagcaagggtgaacctgaaccgggcatccgtggaagaagtcatcgaaaaactggagcgggaagggtttaccgttgagcggagcccggttattccggaagctgtccgctcacgaaaaggcaatcttgcccgctcggcatgctttaaagaagggctcttcaccatccaggatgaaagttcgatggcggttgcctatgcgctttgcatccaggaaggccagcggattctggacgcttgtgcggcaccgggcggaaaaacgacccatattgcggaaaagttagaaggaacgggagaagttgtcgcgctcgatctccatccgcataaagtaaaactggttcaggaaaatgcagagaggctcggtaccggacaggtcgaagcgattgcgatggacagccgggatgcaggcgcccgttttgaaaaaaatacttttgaccgcattcttgtcgacgcgccgtgcacaggttttggcgtgctgcgacggaaaccggatatcaaatatgcgaaaaccgttgacgatatccatgcgctaaagcaggtccagctttcgattttatcgggcgtgtcggaactgttaaaaccggacggcatccttgttttcagcacgtgcaccgttgaccggaaagaaaacgaagggacgattgaaacatttttgcaggaacatccggaatttgaaccgtatccgctgcacgtcccggaagcaatggaatcttgcgttgacggataccggatgcagatttttccgcaggacttcggcggggacggatttttcatcgccagcatccgcaaaaaggccggtaaagcataggtttgcctgatgataaacacgtcaaagagtatgaaggtgggggtataatggaatctgtctacaaaacggacaagggcagagtaaggcagcataacgaagacagtgggggagtctttgaaaatgccggcggtgatctccttgcgattgttgcggatggcatgggcggccatcgtgcgggtgacattgcgagcggcatgacggtgcaatgttttaaagaagcgtttgaaaaattcggcccggttgccgatgcggagtccgcggaggcgtggctttccgagacgatcggcgaggtgaatgcccgtttatttgaacatgccgcccatcaccctgaatgcgaaggaatgggcaccacactggttgcagcggtctgcaccgaaggctttatttccatcgccaatatcggagacagccgcggctatatttttaatgaaaacggcttccagcagctgacggaagatcattcgctggtcaatgaactggtcaaaaccggccagatttcaaaagaagacgccgaaaatcacccacataaaaatgtgatcctgaaagcgctcgggacggaagattcgatctcgcccgacttaaaaacgattgtatttgaagaaaatgatactttgctgctttgttcagacggcctgtcgaataaagtgccgacggaagtgatgaaagaagtgctggaaaaagatctgccgcttggggagaaagcggacatgctcgtggattatgccaatgaaaacggtggggaagacaatattacgattgtgcttctttcgtccggccgcaataaaggcgggtgcccttaatgttaatcggaagacggatcagcggccgctataaagtcaaaagcctgatcggcggcggcggcacggcaaacgtctatctggcccgcgatatgattttggaccgtgatgtggccgtcaaagtgctgcgcccggattttgcaaatgagccggagtttatccaacgttttcacagggaggcccaatcggcaacgagcctggtccatccgaatattgtcagtatttatgatgttggcgaagaggacgatttaaattatatcgtcatggaaaatgtcgagggcatgacgttaaaacaatacatacagcaaaacggcccggtttccgttgagaaaacgctggacattatgggacagcttgcagcggcgatcgcacatgcccatgacaaccatattatccaccgtgacattaagccgcaaaatattttaatcagccatgacggcgttgtgaaaattacggacttcgggattgccatggctttatccgctacttcaatcacccggacaaatgccgtgctcggttcggtccattatctttcccccgagcaggcaaggggcggtgttgccacatataaatcggatatatacgcactcggcatcgtgatgttcgagcttttaacgggaaggcttcctttttccggggaatctgccgtttccattgctttaaaacatttgcaaagcgagacgccgtcgccgaaaaggtggaatcccgatattccccaaagtgttgaaaatattgttttaaaagcaacggcgaaagatccgttttaccgttataacagcaccgaagaaatgggggaggatatccgcaccgcactcctgccggaaaggctgaatgaaccgaaatttgttatcccggaagacgaagatcagacgaaaattatgccggtgatttccgaagtggctgccggccccgaccggaatgaagaaaccattatcgcaaatccggccggagaaaatgaaaaggaaaagaaaccggacacaaagcgggacaaaaaagagaaaaaacggcggaaaaaatggccgttcgttgtcggcacccttgcctttctggtcgtgcttgccggccttgccgccttgttgctgccgtccctgctcggcccgaaaaccgtcagcgtcccgtcagtatcaggcaaaacggcggatgctgctgccgccgtgcttacggcgcatggtctgaaaaccggggagaagattaaaacaacaagcgaaacggtaccaaaggggcaggtgatcaaaacggatcccgaagccggggaaaaaatcaaagaggggacaaaagtttccctttatatcagcacgggaaaagaaacatttaccctgtccgattataccggcaggcagtttgacgatgtcgtgaatttattgactggggaacattttaaagacatcgataaagaagaagtatacgatgacagtgcgcaagggaccattatatcacaggatcccgcgcccgataaaaaagtggtgcccgaaagcacggtgcttacctttactgtaagcaaaggcccggaaatttatgcagtcggggatttaactggattttcaaaaaaacagctggacgcatatgaaaaaacatccggtttttccattgaatatgccggaaaagattattcggataccgtgaaaaaggaccatgtcatttcgcaatccccgcagccgggaaccgagctgaaaaaaggctcggtcgtaaaagtgaccatcagcaaaggacagaaagaaatgccgccaaagacggtcacaaaggaagtaacgatcccgtatgagccggacacggattccgccgggagcacaaatgaaaacaatagcgaaagttccgggtcggacggaaacagccagtccggtgacagcaacagcgaatcaaacggaaacgattccggcggcaaaacagatgcatctgcacaagaaaacccgaaacaggaagtgcaaatttttattgaagacatgaaccattcgatgtccgcacctgttcaaacgtttgagattacgaaaacggtgaaaaaacagctggagttcacgattgaatacgggaaagaggcgacatacaaaatcatgagggatggcaaagtcatcgccgaagagaccgttccgtatccaaattaagaaaacgcgggcgtcccatccttaggcgagagcagcgccgtcgttgcatttatgcgttaggaaagtagaaattgaaaaatttatcctttcttaactgagaaagcgccgggccgtaacccggcgcctcccctggtttgaaaatgtcggagagatggaggtggatgtatggcagaaggaaaaatcatcaaggctttaagcggcttttactatgtgaaaaatcgtgaagacggcgaaatttaccaatgcaggggcagaggtgtcttccggaaaaggaaaatcaccccgctcgtcggggaccatgtcgaattccaaaaagaaaacgggcgggaaggttatattttggacatcggcgaaagaaagaatgaactcgtccgtccaccgattgccaatgtggatcaggctgttttggttttttccgcaaaagaaccagccttttctacgctgcttttggaccgttttttagtcccaattgaaaagaacctgattcggccgcttattctgatcacaaaatgcgatctcttgggcgcggatgaaaaagaaaagctgctcgagacgcttgcagtataccggcaaatcggttacccggttattttgtcgtcggcgaaagcaggcgaaggggcagatgctttgctttcggcattgaaaggaaaaatcaccgtcttttgcggccagtccggagtggggaaaacgtccattctcaaccgtctggaccctgctttgggtttaaaaacaaatgaaatttccacgcatctgggcagagggaagcacactacccgccatgttgaactattgccggtcggaggcgggctcgtcgcggatacgccgggtttcagctcactcgacttcgccggcgtggaattcacggagctcggggcctattttccggaaatcagtgaaaaatcggccggctgcaagttccgtggctgtctgcatgaaaacgagccgcattgtgcggtaaaagccgctttggccgaaggggagatcgcttcattccggtacagccattacatccagtttcttcaggaaattaaaaacagaaagccgaggtattgacgatggtaaaaatcgcaccttctattttgtctgcaaattttgcaaaactgggagaggaaattaaagatgtggaggaaggcggggcggactggatccatattgatgtaatggacggccattttgtgccgaacattacgatggggccgctcgttgttggggcggtgcggccggtcacaaagcttccgctcgacgtccatttaatgattgaaaatccggaccagtatttggaagcttttgcgaaagcaggggcggatacaatttctgtccatgtggaagcgtgcaggcatctccaccggacgatccaggaaatccggtcccttggtgtaaatcccggcgttgtcttaaatcccgccacaccggtcgaatggattgcgcccatactgggggatgtcggccttgtattgctgatgacggtcaatcccgggtttggcggacaggcttttattgaatccgttgtcccgaaaattgaaaaactgcaccgtttaaaaaaagagcaggggcttgcatttgacattgaagtcgacggcggcatccatccggaaacagcgcaaaaatgcacacaggccggtgcaacggtgctggttgcgggctccaatatttttaaaagcaagaaccggaaaaaagcgatccaggcattaaaatacgggcagtaaaacaacagccggggttcatccggctttttctgcatgaaaaacccgcggggagtggacaaagcatcaggttgtcttaaatccgtcgtataaaaggggaatgaggcatggaaaagaaaatctatattttagcaggcggcccgcccgaaaatgtaccggatcttgcgccatatgcggaggacaaacgagcggcatgggcaggtgtagacaggggcgtgctgcatttgcttaaacaagggatcatcccggaaatggcctttggcgactttgattctgtcaatcaggaagaatgggactggatcaaccggaaacttgagcatattcgcaaattccagcccgaaaaagatgagaccgatatggagctggccttgatgtgggcaatcagccaggatccggatgtgatccgcatttttggtgctaccggcggacggctcgatcatgcttttaccaatgtccttttacttgtacatgaaaaagctttgcaatttaaaggaaaaatagaaatgatcgacaggcagaatctcgtggaaatgtttttgcccggaacttatacgattgaaaaaatggatgcgtatccgtatgtttcttttctcccgttgacggaagaggtagaagggatctttttaaccggatttaagtatccgcttgaaaaccggcatattgtaaggggcaccaccctttgtgtcagcaatgaactaatccgtgattttggtactttttctttttcaagcggcatattaatgatggtaagaagccatgattaatgatatttcatgaacaagcaggctgtatccttttcgcttacgcatgaatataatgtgcgggagacccggattgtatttgaatggggagggacatacatgaaattttatacgattaaactgcctaaatttttgggcggtattgtcagggccatgctggggacttttaaaaaaggataagagataaaatggacgcatggcggttcgtggggcagttcattctacacagcgggaaaatcggcggcgcgccggttttttttgccgcaaaaaaaacaggaaaccggatacccggtttcctgtttttgcattatacacgttcgactttcccggatttcaaagcgcgagcggaaacccagacgcgttgcggtttgccgtccaccagaatgcgcactttttgcaagttcgctttccaggtgcgtttgtttgcgttcatggcgtgagaacgtttattgccggataccgttttacgtccggtaattgcacatttttttggcattgtattccctcctcctgttgcgaagcagaaatagaacatatttatgctttcatctcttcatttttcgttaaaaattcactataataatttatcatattggaagacacaatgcaagtcctgccggtgagtatacatgcagagcaccctgttttgtggtaaactataacaatgcagtcctgctctgctttccatgtaccctgtcttatagtacaatggcgatagcaggtcaaatccggtttggaaacagtgaagataagggggagcgatttatgccgattgaaataaatacgcattacggacaaattgatatatcgaatgaagtcgtcgccacaattgcaggaggtgccgccattgactgtttcggcattgtcggaatggcctcgaaaaatcaaataaaagacggcattacagaaatcctgcgcaaagaaaacttctcgaggggcgttattgtgcgtcaacaggatgaaaaagtggaaattgacatgtatattattgtgggctacgggacaaaaatttccgaaatcgcccgcaacgtccagcagaaagtaaaatatacgctgaatcaaacagtcggcttatcagttgacgccattaatatttacgttcagggcgtgcgtgtcgcgaacccgtaacgaggaggaaattttgtggttacatcactggatggaaagcgttttgcagaaatggtcatacaaggggcgaaccatcttgcggcaaatgccaaaacggttgacgccctgaatgtattccctgtccctgatggcgatacgggaacaaatatgaatttaacgatgacttccggtgcaaaggaagtgcaaaaaaatgtccaggcgcatatcgggtccgttgccgcaagttttgcaaaagggctgctgatgggcgcgcggggcaattcgggcgtgattttatcccagctgttccgcggcttctccaaatcgattgaaacaaaagcgcatatttccgcaaaagagtttgcagcggcttttcaggccgggatcgagagcgcttttaaggcgatcatgaagccggttgaaggaacgattctcaccgttgcaagggaagcggccaaaaaaggcgtgcaaacggcgaaaaccgaaaaggatctggcggcagtcatggaagcgatcctcggggaagcgaaaacgacgctgagccggacgccggacatgttgccggtgttaaaagaagtcggcgtggtcgacagcggcggccaggggcttgtttttatttatgaaggctttcttgccgagttaaaaggggaagagctgccggatacaccgtccgtcatgccgtcaatggacgagctcgtaaacgccgaacaccataagcatgtgcaggactttatgcgtacggaagatatcaaatatgggtactgcacggaaatcatggtcaggctcgaccgctcgaaaccgtccgccaagacattctcggaggagcggttccgcagtgatatgagccgtttcggggattccctcctggtcatttcggatgatgatatcgtgaaagtccatgtccacactgagcgcccgggtgatgttttgaactacggccagcaatacggcagcctcattaagttaaaagtggacaatatgcgcgagcagcacagcgcgatagtgggcgaaacgcatcatgcgcttgttggcgaaaacggagcggaacaggagaaaaaagaaaagaaagattacggtgtgattacggttgccatgggggacggaatcgctgcgctgtttaaaagcatcggcgccgatgttgtcattgaaggcggccagacgatgaacccgagcaccgaggacatattgaaagccattgaagaggcaaacgcaaaacaaatcatcattttaccgaacaataaaaatattgtcatggcaagcgagcaggcagcggaactagcggaagaaaaagtggctattgtcccgtctaaaaccgtgccgcagggaatggcggcgctgctcgcatttaaccccggacagccgtttgacaaaaacgtccaagcaatggaagaagcgctcggccgcgtgaaatccggccaggttaccaatgcggtcagggatacgaatattgacggcatctccatcaaaaaaggggattatatggggatttacgaagggaaaatcgtcaaaacgagccctgccctgttggaagcatccgggcagctgctttcgcacatgatcggcgcggaagatgaaattgccaccgtcatatacggaaaagatgtcagcaaggaacaggtaaacgaactcgtttcctatattgaaaccaactggccggagatagaaatcgaagtccatgaaggcaggcagccgttatattcctttattttggcagtggaataagattgcttgcccgcatattataaaaagagcttgctgaatacgaaaaaatgcaccatccgctgctgtttgttttcatctgttgcagcgctttcaagtgcaaagctttcatccattcttttttggtaaaaaggttccagttcgggcgagccggccgaaccaacccggttttgcccggcaaactttaaaatcagcacaacggcgggtgcggcctgaaaaacggggcgcacccaccaagattgaaatcgcgaaaaaacacaataatgtgggtgtgatgcgcaatgaaatataaaagtgtttttgatattatcggcccggtgatgatcgggccctcgagctcccatacagcaggtgccgcgcgcatcggtcgggtggcgagaagcttattcggcaggcagccacagtgggcagacatccatttttacggatcgttcgcgaccacctataaaggtcacggcacagacgttgccattgtcggcggcctgctcgattttgacacggatgatgaacggatcaaatcttctcttcagattgcggaacagcacggactttcggtaaagtttttcgtggaaagcgccgtcacggatcacccgaacacggtaaagatccggatgggcgacgcatcgggagatatggaactgaccggtatctcaatcggcggcggaaaaattgaagtgacagaactgagcggctttgaactgcatttatccggccaccatccggctgtgctcgtcgttcaccaggatcgctacggggcgattgcggccgtatccaatattttatcagcacatgaaatcaatatcggccatatggaagtatcgcgcaaagaagccggaaagatggccttgatggctatcgaagtggaccagaatctcgatgacgccgtcattgaagagatgaagcagctcccgaatattacccaggttgcaagagttgtagattaatagtgagaaaaaagcgcagctgctaagcaggtggcgctttcttttggctgtctttaaaaaatgtgcgtgcatccttgcctgtgccaggagaagcagcatggatattgaaggagggaaattatgtttcggaatgttgctgagcttgtagaactggccgaacagcaaaataaaaaaatctcggaaattatgatagagcaagaaatggaagtaaccggaaaatcgagggaagccatcataaaaaagatggatgaaaatctggctgtgatggaaaaagcagttgaaaaagggattgccggcgtccactcccactcagggcttacgggcggcgatgccgtactgctgcaaaaatatattgaaaaaggcaatttcttatccggcgccaccattttggatgccgtcagcaaagccgttgcgacaaatgaagtgaacgcggcaatgggaacgatttgcgcaacgccgacagccggttctgccggcgtcgtgccgggaacgttctttgcggtcaaaaacaaactgcatccgacgcgtgaagaaatggtccgtttcttatttacagccggcgcattcggttttgtggtggccaataatgcgtttatttccggcgcagcaggcggctgccaggcagaagtcggatcagccgccgggatggctgccgcggctatcgttgagatggcgggcggcacaccggatcaatgtgcccatgcgatggccattacgttgaaaaatatgatcggcctcgtatgcgatcctgttgccggtcttgtggaagtaccatgcgtgaaacggaatgcaatgggggcggccaatgcaatggttgcggcagatatggcgcttgccggcattaaaagccggatcccttgcgatgaagtgattgatgcgatgtaccgcgtcgggcagcagatgccgactgcgctcaaagaaacagcgcggggaggcttggcggatacgccgaccgcccggaaactggaagccaaaattttcggtatgccgcttgatctgcatgaatagcccgcttgatctgccggtatccgttttaaaagggatcggcgaagaaacggaagcaagcctcgggcagatggggatttttaccatctatgacctgcttacttattttcctttccggtatgaagatgaccggctcaaagatttgcgtgaagtcgggcatgatgaacgggtgacggtgacggggagggtgcatagcgaaccctccctcatctattattcaaaaaaacggtcacgcctgtcgatgaaagtgttcgcaggcgattttctcattacggttgtctgttttaaccagccgtatttgaaaaagaaaatccatgtccatgatgagattacggttaccggaaaatgggacatgcaccggcagacgattacggcccaatccgtaaaaacaggcacggctgatcaaacgtccggattcgggcccgtctatgcggtgaaaggaaaaatgacggtaaaaacgttgcgcaaatacattcaatccgcctttcatgcttatggcagtgaaatcgaagaggcgctcccggcagaaatgcttgcaaaatataaattaatgccgaaaaagcaggccatgtttgcgatgcacttcccaaaatcggaacaagaagtgaaaatggcgagaaggaccattgtatacgaagagtttttggcttttcagctgaagatgcaggcgttaaggaaattcgagcgcgaacattcaaacggccgggccatccgctatgatgtgcggaaattaagacattttatcgactccttgccgttttcattgacggccgcccagaaaagagtggtaaacgaaatttgcgcggacatgaagtcgccgttccgcatgaaccgtttactccagggggatgtcggctccgggaagacggtcgttgctgcgattgcgctatacgctgcggtgacggcgggatttcaaggggcactgatggtcccgacggaaattctcgccgagcagcatgccgaatcgctttgccagctgctcgaaccgcacggcgtccaggtcgctttactgacgagcaccgtaaaagggaaacggcgaaaagcgcttttggaacagcttggtacaggcggtatcgatattttaatcggcacgcatgctttaatccaggaagatgtggcattttcccggctcggccttgtgatcacagatgaacagcaccggttcggggttgagcaaagacggatccttcgcgaaaaagggatgaatccggatgtgctttttatgacggcgacgcccattccgcggacgcttgccatcaccgtgttcggcgaaatggatgtttctgtcattgaccagatgccagctggccggaaaaagattgaaacgtactgggtgaaaaacaatctgttcgaaagggtgctcggctttatcgaaaaagagctcaaaaaaggcagacaggcgtatgtcatttgtccgctcatcgaggaatccgataagcttgacgtccagaacgcgattgatgtgtatgccattttaaaccaatattttaatggcaggtatacagccgggctgatgcatggcaggctgccgggtgacgaaaaggaagcagtcatgaaagcgttcagccgcaacgaaattcaagtgcttgtgtcgacaacggttgtcgaagtcggggtcaatgtgccgaatgcgaccattatggtcatttatgatgccgaacggttcggccttgcccagcttcaccagttgcgcggccgtgttggcagaggcgatgcgcaatcgtattgtattttgctcgccgacccgaaaacagaaatcggcaaagagcggatgaaaattatgacggaaacggacaacggctttgttttgagcgaaaaagatctcgagcttcgcggacccggcgattttttcggaaaaaaacaaagcgggctgccggaatttaaagtggccgatatggtccatgatttccgggcgcttgaaacagccaggcaggatgcgcagcaattgatcagttccgatacattctggcatgacccggctttttcacacttgcggcgccagcttgaagcatcaggtgtgctcgaaggggagaaactggactaaagggagtttgcgttttgccagggcagctttggcaattcttgcaaacttccttttctttctatatactacgattagtaccaagtcctaaaatttcggatggtgtcacccatgaaaatgaaaaaaaaggaccggcagcaaagtttgcaggaaaccatcaggcagaatccttttatcacagatgaagaactggcggaaaaataccatgtcagcgtgcagacgatccgccttgaccggctggagctttccattccggaactgcgggaaaggatcaaaaacgttgctgaaaagcggttcgccaatgaagtaagggcgctgccgatcgaagaagtcatcggggaagtgatcgatatcgaattggatcgcagcgccatctctatttttgatgtcaaaaaagaacatgtttttaagcgaaacgccatcgcccgcgggcatcatctgtttgcgcaggccaactcgcttgccgttgccgtcattgatgatgaactggccctcacggcgaaagccaccatccggtttttgcggtccgcgaaaatcggcgaccgcgtcattgccaaggcaaaagtggcgaacgtcaatcaggaaaacggcagaacgactgtgcttgttgaaagctatgttggccgtgacctcgtctttaaaggcgaatttgaaatgtatcgggatcatgccggaaaaggcggcagtgcttaactatgcttcgcggacaggtaaaccattttcccgggtaccggcacccccggttgcggcatggccgggaaaactttcgcacgggaaaagcttgattttagaaacggggctgaacagaatgagattagcaattgatgcaatgggcggggattatgccccaaaagaaattgtacaagggattaaccgggctgtaaacgcatttccggacacggcgtttatcctgttcggggacgaaacgcaaatcaggaaggaactggaaacgtctgaccgcgttgccgttatccataccgatgaggtaatatctggaacagacgaacctgtgcgggcagttcgccgcaaaaaaaattcttccatggtgcgtatggcccaagccgtgaaagacggggaagcggacgcgtgcatctcggccggaaatacgggcgctctaatggcatccggtctctttgtggttggcaggattgaaggtattgaaaggccggcccttgccccggtgctcccgacaacggacgggcgcggttttgtcatgctcgatctcggcgcaaacgcggaagccaagccggaacatttgctgcagtttgccatcatgggctcgctgtatgccgaaaaggtaagaggcttaaaaaatccgcgcgtcggcctcttaaatatcggaacagaagaaaagaaaggcaatgaattaacaaaaaaagcatttcaacttttaaaagaaactgatttgaattttaccggcaatgttgaagcccgcgacttgctcgagggggcggcggatgtcgttgtcacagacgggtttaccggcaatatggtgctgaaaacgattgaaggtacggccggatccttgttttccatgatcaaaaaagtgttcatgcacaatctgaagacaaaactggccgctgcgatgatcaaatcagaactgtcaggcctgaaaaatatcatggactactcggaatacggcggatcgggtttaatggggctgaatgcgcccgtcattaaagcacacgggtcatcaaacgccaatgcaatttacaatgcggtgcggcaggcgcgtgaaatggtacagtctgacgtcaccggcaaaatcaaacacgcaattcaacaacttgaacaaaagtaaggatggaggaaaagagatggggaaaatagcatttgtttttccggggcagggatcccagacggttggcatggggcagtcggttgccggtgcaaatgaaaaagcggcggctgtttttcaaaaagcagatgaaaagcttgggatggacttatccgggctcattcaaaacggcccgctggacaaactgacccgtaccgaaaatgcccagccggcccttttaacggtaagcactgcgattttacaggtgcttcaggaagcgggcatccatgcagatttcacagccgggcacagccttggcgaatattcggcgcttgtggcagctggcgctttgtcttttgaagatgccgtatatgcggtacgcaaacgtggcgaatatatggatgaagcattcccgaacggtgccggggcaatgtccgccgtgctcgggcttgaccgcggcgtgctagaggaagttgcagatgaagtgagccgtgaaggggaaacggtccagctcgcgaatttgaactgtcccggccagatagtcatttccgggacagctgccggaattgagaaagcgggcgcccttgccaaggaaagaggggcgaaacgcgtcctcccgcttcaggtaagcgggcctttccactccaaattgatggagccggcagcggaaaaatataaggcggttcttgacgaaattgctatccgggatgcggcggttcctgtgatcgccaatgttgatgccgaagtggaaacgggcgctcaggacatcaaagcaaattgtatccgccagctctattcccctgttttatgggaagattctgtcaaaaaaatgatcagcctcggcgttgatacctttattgaagtcgggccgggcaaagtgctttccggattaatccggaaaattgaccgcagcgtaaaaacatatgccgtccaggatatggaaaccctggaagctgcggttggcgcgttgcaaaaataatggaggaggagaccgaatgcttttaaaagacaaagttgcgcttgtgaccggtgcgtcccgcggcatcggccacgaaatcgcgcttgcgtttgccgcttccggcgcgcatgttgtggtcaactatgcagggaatgctgaaaaagcggaagaagtggtaaacgccgtccgttcttatggtgtggaatcctttgccatccgggctgatgtttcgaatgaatcggaagtgcaggaaatgttcagacaggtgctggaaaaattcggcaaacttgatatattggtgaataacgccggcatcacccgggataaccttttgatgaggatgaaagaagcagaatgggatgcagtcatcgataccaatttaaaaggggtcttcctgtgcacaaaagcggcggcgcggccgatgatgaagcagcggagcggcaaaatcattaatattgcctcggttgtcggcatcagcggcaaccccggtcaggccaattataccgctgccaaagccggcgtcattgggcttacaaaaacggcggcgcgtgagctggcaagccgcggtattactgtaaacgccattgccccgggcatgattgaaacggatatgaccgataagctgacggaagacatcaaagaaggcatgctgggccaaatcccactttcccgtttcggcaagccggaagatgtggcaaagactgccctgtttttggcaagcagcagttccgactacatcaccgggcaaacgatccacgtcgatggcggaatggtcatgtaacggttgcggcaaagcttgtttttaagtttcactttattaattataaaaaatcctctataataccttgaggggaggtgaaccgcatggcagacgtattagagcgtgtgacaaagatcatcgttgaccgccttggtgtcgaagaatccaaagttacactggaagcgaaattcaaagaagatcttggcgctgattcccttgatgtagtggaattggtgatggaattggaagatgaattcggaatggaaatttctgacgaggatgctgagaaaattgtaacagtgggtgacgctgtaaattacatacaaaatcagcagtaatcgtcttcatgtaaaatgtcccgccccataaagcgggacatttttctctaatccggcgtcaatcgtctcctgcctgaggatggtaaatgggcaaaaaagcgcgatccctttttgcctatttacgaccgcccgggtcctgggagatgcctttgcgttcagcagtatttttctatatatttaagttaagttgaaactatatcaagatatcgggtggatgaacgatggtaaaaaaaataaaatcagatgaagaacatgtagtaaacaaattcggcaagctgcaggaacaactcgggatccattttcaagacgtaaacctgctgaaacaggcttttacgcattcctcctatgtgaacgagcatccggaaaagcgcaggcacgacaatgaaaggcttgaatttttaggcgacgccgtcctggaactgaccgtgtcccattatttatttaatcggttcccgtcgatgaacgaaggggaaatgacgaaattgcgggcgtccgtcgtctgtgagccgtcgcttgtcatttttgccaatgagctgcattttggcgagtatatcctgctcggtaaaggcgaggaaatgaccggcggcagaacgcgcccggctcttttagccgatgtgtttgaagcgtttatcggcgcgctttatttggacaaggggttaaaggctgttgtttcccttcttgaaaaagttgtattcccgaaaatagacgaggggctcttcagcagcacggcggattataaaagcaagttgcaggagtacgtccaaaaaagaacatccggtgtgttggaatacacgattctcgatgaacgcggccctgcgcatgacaaggagttcatctccagcgtgtcgctaaacaataaagcgctcgggacaggaaaaggccgctccaaaaaagaagcggaacagcaggctgcgcaaacggctttatccaatttgcagaaagaagaaaaaaagaagccgtaaagaatggagggggaacggattgtttctgaaacgtctcgatgtgatcggatttaagtcatttgcggaccggatttcctttgaatttgttccgggcgtgacagcggttgtcggcccgaacggcagcggcaaaagcaatgtgatcgacgccgtccgctgggtgctcggtgaacaatcagcgaaaagcctgcgcggtggaaagatggaagatgttatatttgccggcagcgatacaagaaaaccactgaattttgcagaagtgacgttaacgcttgaaaacgaaggccgcgcccttccaattgattaccaggaagtgagcgtgacaaggcgggtgtaccgttcaggggaaagcgagttttatatcaataaacagcaatgccggttgaaggatattgtggaattgtttatggattccggccttggcaaagaagctttttccattatcagccaggggaaagtggaagaaattttaaacagcaaagcggaagaacgccgcagcatttttgaagaggcagccggcgttttaaaatataagacgcgcaagaaaaaggcggaagtgaagcttgccgaaacgcaggataacttaaaccgtgttagcgacattctgtatgaactggaaagccagcttgagccgttgaaaatgcaggcatcggtcgcaaaagattatctggaacaaaaggaagcattgaaaaattatgaaattgccgttttggcgtatgaaatagaatcattgcatggcgagtgggaatcgcttaaatcgcagcttgaagcacaccgggataaagaagcggggctctcttccgaaatccgcaaacaggaagcacagctggaagaaaagcgcaatcagctggacgcgctcgatgaatcgattcaagacttgcagaatgtgctgcttcaagcgacagaagagctggaaaaactcgaagggcaaaaagaagtgctgaaggaacgcaaaaagaacgccagcgagaacaaagcccagcttgagaaaaatataaatgaagcggagaacgctttaaaagaactggaagcccaaaaggaaaagcttttgcaaacggcggcggaaaatgaacaagccttatcgtccctgaaagaaagcgtgaaagagaaggaagcgggccttttccgcctcagcacgaatctggagggaaaaattgagtctttaaaaagcgactatattgaactgctgaatgagcaggcaagcggaaaaaatgaaaagcgcctgcttatgcagcagctgcaaacgtcgttaaaccgcctcagccggcttgaagccgaaaaccggaaatatgtcgaagaacgggaaaaagtgcgggaaaagaaaaaaatggcgaccggccgccttgcaaaaatcaaacaggagctggaagcggcagccggtgcctatatggaaaagcaaaggcagctggaatccgtaaacagtcggtatcaaaaacaggagtccaatctgtatcaggcataccaatatttgcaaaaagcgaaatcacggaaagaaacgcttgaagagatggaagaagattataccggcttttaccaaggcgtgcgtgcaattttgaaagcccgcggcaaacagctggaaggcattgaaggtgctgtggctgaactggtccgggtgcccgcgccttacgaaaaagcggttgaaacagcactgggtgcttcgatgcagcatattgtgacagaaacggaacggcatgcgcggcacgccattgcatttttaaaagaacgaaaggccgggcgggcgacttttttgccgctcgatattattaagccgcgggccattccggaagcaagcctcaaaccgctccgcaatgaagaggcgtacgtcggcgtgtgcgcggagcttgtccgctttgaaagccgctaccagtccattgtgtccaatctgctcggccatgtccttgtagtccgtgatttaaaaagtgcaaacaaaatcgccaaaatgctcggctaccgctaccgcatcgtgacgcttgacggggatgttgttaatccgggcggctcgatgacaggcggggcttcgaaacaaaacagtgtgtcactcctttcgagaaaaagcgaactggaagcattaaaagaaaagcttgccggcatggaaaaaacaacgatggcgcttgaaacggaagtcaaagcattgaaagccgaagcttcccgcatgcaacaggagctggatgaagcgaggaaaaacggcgaagcgctgagacttggagaacagcaggcgaaagcggaactggaacggcttgcggttgaggaaaaaaatctggatgagcacctgctcgtctacgatatggaaaaacaagaggcggaaaagcagcaggatgaagcccgtaaacggatcggcgaactggaagatatgctggcgcgtaccggcgaaaaagcgcagcaactggaagcggaaattgaagccctgaccgtaaagaaaaacgatgattcgacggcaaaaagcaggctccagggcgaactgagcgatttaaaatcgacgcttgccgtaaagatggaacaggcggcgcgcgaccgcgaagagcttgcgcggctcgaccgtgaaataaaggagtgggcgtcacgtaaagcgcgttacgatgagcagtaccactttcttacggacgaatcgaagaagcatcacatgtcggaaagcgaactggcagaagcggccgaacaaaaagcgcgtgacaaaaacgatacgctcgcctttatcgccgtgcgcagggaagaacgggcccggctgacagcagagatggaagacctggaacgcggcctgaaggaatggaaacggcagcaaaaagggctccagcaggccattcaggatgaagaagtcaaagcaaaccggctggatgtggaacttgagaaccggcttcaaaggctccgcgaagaatacacgctcacctttgaagccgcgaaagaagcccgcccgctcaatgtttccctggaggaagcacgcaaaaaagtgaagctgatcaaactgtcgattgatgagcttggcgccgtcaatctcggcgcgatcgaagaatatgagcgcgtatcggaacgttaccagtttttaaaagaacaggagaccgacctgcttgaagcaaaagacacccttgaccaggtgattacggaaatggacggcgaaatggtccgccggttcgatgagacgtttaacgccatccggaacgaattcgaacccgttttccgcgagctttttggcggtgggagagcggatttgcggctgacggatccgaaagatttgcttacgacaggcgtggaaattttcgcgcagccgccggggaaaaaactgcaaaatctcgggctgctttcaggcggcgaaagagcgctgaccgcgatcgcgcttttgtttgcgattttgcgtgtgcgcccggtgccgttttgcattctcgatgaagtggaagctgcgctggatgaagccaatgtataccggtttagcaaatatttgaaacaattcagtgcggaaacccagtttattgtcatcacccaccggaaaggaacgatggaggaagcggacgtcctctacggggttacgatgcaggaatccggcgtatcgaagcttgtgtcggtcaaactggaagaatcaaccgacctcgcttttcaaacgtcttaaacaggcgaatcagcgccgtgtttaaaaagaagcgcccgtgccacaagcgggccggcagggataaaaatcaggccggcgatttttacgactgctcgtgcggcttttatgccgcacaagctgatacgcaaattcaggaaagccaaaggaagtggacaaatgagcttttttaaaacattaaaagacaaattcacccggcaagccgatacggtaaccgataaatttaaaaccgggcttgcaaaaacgcgcgataatttctcgaacaaagtcaacaatcttgtcgcgcgttaccggaaaatcgatgaagactttttcgaagaactggaagaaattttaattcaggcggatgtcggcttccagaccgtgatggaactaatcgatgaattaaaaatggaagtgaaacggaaaaacattaaagacccttctgaagtccagtccgtgatttccgaaaaactggttgacatttattcggccggcgaagatgccccgaaccggcttaacatccaggacggcgccttgaccgttattttgtttgtcggcgtaaatggcgtcggcaaaacgactacgatcggtaagctcgcccatatgctgaagcagcaggggaaaaaagtgatcatggcagccggcgatacattccgcgccggcgcgattgaacagcttgaagtctggggagagagggtcggcgtggaagtgatcaaacattcggaaggatccgatccagccgctgtcatgtttgacgccgtccaggcagcgaaagcaagaaatgcagatgtgctgctttgtgatacggcgggccgcctgcaaaacaaggtcaatttgatgaaggaactggaaaaagtaaagcgtgtcatcgaacgggaaatcccgggcgccccgcatgaagtgctgctcgttttggatgccaccaccgggcaaaatgcgatggtgcaggctaagacgtttaaagaagcaacagacgtaaccgggattgtgctgacaaaattggatggcacggcaaaaggcgggattgtgctcgcgatccggaacgaactccatattcccgtcaaattcgtcggcctcggcgagaaaatggatgaccttcagccgtttgatgcggaaaaatatgtgtacgggttgttttccgatctgatcgatgaagtgccggaagaacaagcctgaccgtatgtgggccgtactgcgaatcagaaggccgcggtattaaagcccgccgggagcgcttcaaatcggttgtggggaaacgaacttgttttcattgacaaaaaacaggaatctttgtattctgtgtttatgtaaagcattttcacttaacagggggaagaagccatgctggagaaaacaacgcgaatgaatgatttgtacgatttttaccaatcgttgttgactccgaagcagcgcagctatatgtccctctattatctcgacgacttgtcgcttggcgaaatcgccgaacaatacggtgtgagtcgtcaagcggtttacgataatatcaaacgcaccgaacaaacgcttgaagactatgaaaaaaagcttggtttattggaaaaatttcaagcgcgcacacgcattttccggtcgatgcgcaatcttttggcgcatgatgccaatccggaactgttgcggcttgtcgatgcgctcgaaaaattggaatagggggcggaaaaatggcatttgaaggactcgcagaacgcctgcagggcacgatgcagaaaatccgcggaaaaggcaaggtcacggaaagcgacgtcaaagaaatgatgcgggaagtccgtcttgcccttctggaagctgacgtcaacttcaaagtggtaaaagattttgtaaaaaaagtgagtgaacgtgcggttggccaggatgtgctgaaaagcctgacgcccgggcagcaggtcatcaaaattgtccaggaagagctgaccaaccttatgggcggatcgcagagcaagattgccgttgcaaagcgcccgccaaccgtcatcatgatggttggcctgcagggtgccgggaaaacgacgacatccgggaaactggccaacctgttgcgaaaaaaatacaaccggaccccgctgctcgttgcggccgatatttaccgccccgctgcaatcaagcagctggaaacgctcggcaaacaactcggcatgccggtgttttcgcttggcgacaaaatcagcccggtggaaattgccaggcaagcgattgaaaaagcaaaagaagaacatcacgataccgtcatcatcgatacggccggccgcctccatattgacagcgagctgatgaatgaactgaaggaaatcaaggaacttgcgcatccggatgaaatttttcttgtcgtcgatgcgatgacaggccaggatgccgtaaatgtcgcacaaagttttaatgaccagctcggcatcactggcgtcatcctgacgaagcttgacggcgacacgcgcggcggggcggctttatcgatccgggccgtaaccgaaaagccgattaaatttgccgggatgggcgagaaaatggatgcgctcgaaccgtttcacccggaaaggatggcctcccgtattctcggcatgggcgatattctgtcgctgattgaaaaagcacaggaaactgtcgacgaagaaaaagcgcgcgcgctcgaaaagaaaatgcgggaccagtcatttacgctcgatgatttccttgaacagctcggccaggtccggaaaatggggccgctcggcgacattttgaaaatgatcccgggggccaaccggatgaaagggatggataatctgcaaattgatgagaaacaaattgcgcatgttgaagcgattatccagtcgatgacaaagcaggaaaaaatccgcccggacatcatcaatgcaagccggaaaaaacggattgcgaaaggttccggccgcccggtacaggaagtcaaccggcttttgaaacagtttgaagaaatgaagaaaatgatgaaacaactgcagggcatgaatcaaaaaggccggaaaaaaggctttaaattcccttttatgtaaaaaacgagggtgttaagagaaaagactttacaccatcatgattttctgatatgatacagtcttgtgagaaacttttttggaggtgtatgattaaaatggcagtaaaaatccgcttgaaacgcatgggcacaaaaaaatccccgttttaccgcattgttgtggcagattcccgttcaccgcgtgatggacgttttattgaaacagtaggaacttacaatcctgttgtagatcctgcagaagtcaaaatcaacgaggaagccgcgctccaatggctgaaaaacggcgcccaaccgtctgacacggtacgcaacttgttttcaaaacaaggcattatggaaaaataccataacgaaaaacacggcaaataatcatggaccaacagatggatgatttaatcctttcgatcgtcaagccgattgtcggccatccggatgaggtgcgagtagagcgggatgaacaagaatccggaacgctctaccgcctgattatccatccggatgatgccggcatggttattggcaaaaaagggcgtaccgcaaaggccatccgtacggtcgtatatgctgcggccggcgtgcacgggcataaaaaaatccgtcttgaaattgccgaataacggacaacgatggatagaacaccagagaaagggaggcgcacacctccctttttacatacatctttcgggctttcccctcatcttaaccgacatccgctttttccggcttcttttatttgggttgctaataaatggcgaaaaggagggcagggcatcttgaaaatccttcaaaaagtgacggtcaagcaaatcctgaccgaaaagagcaaagggatgcttttggatacataccggcaaaagaaacaacaacttcaaaaagaatgtgagcagctccggtttgaaacgaaaaaactggaaaaacaaaaaaagttttcgggaaccaatttaaaaatgcattttgaaaaagaaattgaaagccggcaggagaaaatcaaactggtggagtttcaaattgaacaactgcttttgcttccgatcgggacggaattaaaagaaaaagaaatgcacgctattgttgacgtccgggaaggcgacgactggagtgcggtgacaaaagagaaatcgattattataaaagacggcatcatccatgaaattcgcgagaggtgagaatatgacacaatggtttaatgtcggcaaaatcgtcaatacacacggcatccgcggagaagtgcgggtcatttccaaaacggatttcaaagcggaacggtataaaccgggcaatacgctttacttgtttcttcccggctgcaatgaaccggttgcgcttacgattgaatctcaccgggtgcataagcagtttgatttgctgaagtttgagggctttgattcgattgaggaagccgagaaatggaaaggcggcatgctgaaagtttccgaagaccagctggatgaacttggcgaaaatgagttttattttcatgaaatcatcggctgcgaagtcgtgacaaccgcaggcgagaaagtcgggacggtaaaagagattttaacgcccggggcaaatgacgtctgggtggtgaaaacagcgcagcaggaagaggcgctaatcccgtatattgaagacgtcgtcaaaaaagtcgacaaaaaagaaaaaagaattgtaattgaaccgatggaagggcttttgccatgaaaatagatatattgacgctgttcccggaaatgtttgaaggcgttctcggatcctccattttaaaaaaagcagaagaaaaagggatcgtccattatcatctggtcaatttccgtgaatacagcgacaacaagcataaaaccgtcgatgactacccgtacggcggcggggcgggcatggtgttaaagccccagccggtgttcgatgctatcgaagaccggcttgagggaagcgaaaaaaagccgcgcatcattttgctctgcccccagggggaaacgtatacgcaacaaaaagcggaagcgtttgcggaagaagaacatctgatctttatttgcggccattacgaagggtatgatgaacggatccggacgcttgtaaccgatgaaatctcaatcggagactatgtgttaacgggcggcgagctgggcgcaatggtcatgatcgacagcatcgtccgcctgcttcccggtgttttgggcaatgaaacctcgcctgttactgattctttttcgaccgggctgctggaacatccgcattatacgcggccggcggattttcgcggaatgaaggtgccggacgtgttattatccggaaatcaccggctgattgaagaatggcgcgaaaaagagtcgctgtaccgcacctatacgagaaggccggatcttttacgcggatatccgctctccgaaaagcaaaaagcgtggctgaaagaatgggaagaaaaacgcggatagctgttgcaatcagcatgcgtttatgctaagattgcttttgtggtttgcttgaaaacaaggcagaccgccgtaaaacgatgttccgctgcaaatacgatggaagatttgcaagagcatttgttggaaggagttgaatacgatgcacaatattattgacgaaattacaaaagatcaacttcgcactgatctgcctgctttccgcccgggggatacggtccgcgtccatgtaaaagttatcgaaggttcacgcgaacgtatccaggtttttgaaggtgtggtcattaaacgccgcggcggcgggatcagcgaaacgtttacagtccggaaagtttcttacggtgtcggcgttgaacgtacattcccgctccatacaccaaaaattgcgaagcttgaagtcgtgcgtcgcggtaaagttcgccgtgcgaaactttactacctgcgtaatctgcgcggtaaagctgcccgtattaaagaaattcgctaatttgctgcaacggctgttcgaaaaggggctatcatggccccttttcttcatacttatacataaataacccgggtgtctctgaggttttcaatcggcaaccaatcctgttataatgcaaaatatcagggaatatacgcttatggatacatggaatgaggcggtgtaaataaatggcaaaacagaaaaaaccaaaaaatgaactgttcgaatgggtgaaagcgctgctgattgctgtggcactggccggcattttgcgctactttttcttcgccccgatcgtggtcgacggctcttccatgatgccgactttgaaaaacggcgaccggatgattgtgaataaaatcgggagcccgaaacggttcgacatcatcgttttccacgccccggaaggcaaagattatatcaaaagggtcatcgggctgccgggcgaccggatcgagtataaaaatgacatcctgtatattaacgggaaagcgtataaagagccttatctcgataaatataaaaaagccgtagccgacggaccgcttacggaagattttaccttaaaagactatatcgggcgcgacacggtgccaaaagggcagatttttgtgatgggcgataaccgccggtacagcaaagacagccgccagatcgggacgattccgctcagcaaggtggtcggggagacaaactttgtatactggccggtgaaagatgcccatatgatcaataaataagcgcccgttcgttgcgcattttacggaaaaaagtaaccgttatggagttgacgcatgatggcaatacaatggtttccgggccatatggcgaaggcaaggagagaagtgaccgaaaaattaaaactggtcgatattgtttttgaattgcttgatgcaaggatcccggtttcctccgccaatccgatgctggatgaactgattcagcaaaagccgcggatcaaattgctgaacaaggccgatatggcagatccggccgctacagcccgctggcttgaaaaattgtccggcggcaatacgcatgtccttgccattgacgcgcaaagcggaaaagggctcgacaaaatggtgaaactggctgaacagattttggagccaaaatgggagaggatgcgggcaaaaggcatccggccgcgtgcgatccgggccatgattgtcggaattccgaacgtcggtaaatcgacgctcattaaccggcttgccgggaaaaatatcgccaaaaccggcaatacgccgggcgtgacaaaagcgcaggcatggataaaagtcgggaaaacgatggagctcctcgatacgcctgggatcctttggccgaaattcgaagacaaagaaaccggttataagctcgctttaaccggtgcgattaaagacacgatcctcaacctgcaggacgtttccgtatttggcctgcgttttcttgaaaaacattatcccggcacattaaaagcccggtacaagcttgaggatatcccggatattgtccccctttttgaccatatcggtcgcctgcgcggctgcttgcgggcgggaggggaaatcgattacgacaaaacggctgaagtgattatccgtgatatccgcggcatgaaactggggcctctgacatttgatttgtaataagcgctctccgtaagggagtgcttatttttcggggaggggaaacattgaaaatcagtgaaattgaagcgcgtcttcaggaaatcacaaacccgtccgatccgtttatccaggcgctaggccgggacgaacggaaaggcgcacaaaaagcgctggaaaaatggatgagaaaattacaaaaagagcgtgaacagcttgaaaaattccgggagatgggacggtttgaagacgccctgcgcagccacggctgccgcctgatcgccggaattgacgaggcaggcagggggccgcttgccgggccagttgtagccgctgccgtcattcttccagaagatttttacctgcccggcctgaacgattccaaacagctttccgaaaaacagcgggaggccttttttgcgcggatccaggaagaaacccttgtcggcgtcggctttgccagcgcagaagaaattgacaggatgaatatttacgaggcggccaaaaaggcgatgcttgcggctttgggccatttgcctgctgctcctgaccatttgctgatcgatgcgatggaaattcccgcttcgtacccgcaaacttcgattgtaaaaggggatgcgaaaagcatttcaattgccgcggcatctgtggttgcaaaagtaacgagagaccggtatatgcaggaaatggatgaaaaatatcccggttacggtttcgccatacataaggggtacgggacgaaaaaacatctggaagcgctcatgaagcttggcccgtgcccgatccatcgaaaatcgtttgcgccgattaaagacagaccggcaatccgccgataaataagcaagaagaaagaaacagggcgggggaatagcatgcaaatttttttaggcaaacagccattttctattgatgccggctcaaatatccgcacgtttgcatttcaaacggggcagattttttccggtgccatccaaaaactgtttccaaatgacaccgcacttgtccaggcaggcgggcgtacatttgccgcgaaactcgaagtgccgcttgaagccggaaaaaactactggtttcaaacggttttggccgacggtgaagtgcagttgaaaatgctttcggaagccgatgcaaacggcatggccgggaaagctttgctcccgcaaatgcaactgccgccaggaaaaacgttccagtcccttgtttcgtacttggctgaacaggaaattccgtttacgaaaaatgacattgctgcgatcggcgcatggctgaagcatgtaccggatctggcaaacgggctggaaacggctgcctttatgctccaagaaggctttcctgtgtcagagggcgtgttcacttcgctccttgccgcaggtcaaaacataccggcggatcagcttttaaaccggttgcagcaggcgctcaagcagggggaacagacgccggaaacgaggcaattgcttgcacttatcggggagcttgggacaggcagcgagcaggtgacaggagaggcgttacgccggcaaatcaaagagaagattcaaaaaatgggacttttttatgaggcggggcttttgcatgaggacaaagccgcggacaaggacgggctgactttaaaagcgctgcttgttgatttgctgcaaaaaggcgggggaacaaaagctgcccgggatgcagcagacgaaatcgtacagaaactgaacggccagcagctgctcgcgctttccggcggggtagtgcagcacatttggatggaaattccgctttcattcgcgcactttcaaacgaatgccgttgtacaatggtcaggcaggcggaaaaatggcggaaaaatagacagtaattattgtaaaatcattttttacttgaatcttcagtttatgaaagaaacattggtcgagatgaatgtgcaaaaccggatcgtttccatccgcatttccagtttgaaaaagggtcttcaggaagccgtgaagccttttttgccggctttaaaggaaggcctttccaaaaccggttacacattgtctgacgttcggttcggggaattccagccggatgctgtgcgtgccacgctcagccggccggaggtttccgggaaaggggttgatcttaggatatgaaggatccacaaaaggacataaaagaagcggtcgcgctccagtacagcccggatgcgcattccgcccctgtcgtgaaggcaaaaggtaaaggggatgtggccaggcggattattgaagaagcaaaaaaagcgaatgttccgatccagcaggacccggatcttgccgcactgctcggccggcttgacatcaacgaagcgatcccggaagaactgtatgcagctgtggccgaggtgtttgccatgatttaccgcctcgaccagtcgctaaaaaacaaggataaaaaatgaacgaaagctgaccattaagcctgggcacccatttgcataaaggctgcggtgacaataggccaacgaccagtaaaatcacgtccattttataccgaaaaaaatattcttgaataataatagccattttagttcattatggtagacatcttttccgatgtttattaaaatgaaagcgcagttaattttttgaacagtttgataggaggatggaacatgaatattcacgagtatcagggcaaagagatcctgagaaaatacggggtcgctgtgccgaacgggaaagtggccttcaccgtggatgaagcggtggaagcagcgaaatcgctcggtacacaagtatgtgtggtaaaagcgcaaattcatgccggcggccgcggaaaagcaggcggcgtcaaagtggcaaaaaatttggatgaggttcgtacatacgcacaggaactgcttggcaaaacgcttgtgacgcatcagacaggccctgaaggaaaagaagtgaagcgcctcttgatcgaagaagggtgcgacattcaaaaagaatactatgtcggccttgttttggaccgtgccacaagccgggttgtgctgatggcttctgaagaaggcggcacggaaattgaagaagtggcggcgaaaacaccggaaaagatttttaaagaaaccattgacccggcagtcgggctcttgccattccaggcgcgccgcattgcgttcaacatcaatattcctgctaaacttgtaaatcaggccgttaaatttatgacaggcctttatcaagtatttgtggaaaaagactgctcgatcgcggaaatcaatccgcttgttgtaaccggcgacggaaaagtaatggcgctcgatgccaaattgaattttgattcgaacggcttgttccgccagcaggatgttctggcgtaccgcgatctcgaagaagaagatccgaaagaaattgaagcgtcgaaatacgatttgagctatgtcgcccttgacggcaatatcggctgcatggtaaacggcgccggccttgcgatggcgacaatggacattattaaatattacggcggcgatccggccaacttccttgatgtcgggggtggcgcaacggaagaaaaagtaacggaagcgtttaaaatcattttatcggatgaaaaagtcaaaggcatttttgtcaacattttcggcggcattatgaagtgcgatgtcattgcttccggcgtcgttgcagccacaaaacaagtcggactcgacatcccgctcgttgtccgtcttgaagggaccaatgtggaacttgggaagaaaattttaaacgaatctgggctgaaaattgttgccgctgaatcgatggcagacggcgcgcaaaaaattgtcgaactggtcagctgacagcagctgttcattcagacaaaatgcgaacaaatattcttgaatgaagaaggcaggggaaaaaagtgagcatttatgtaaataaagacacgaaagtcattgtccaggggattaccgggaaaacggcgcttttccatacaaaacaatgcttggaatacgggacgaaaattgtcggcggcacaagccctggcaaaggcgggactgaagtagaaggcgtgccggtctttaatacggtgaaagaagccgttgaaaaaacgggcgcaaccgtttcagttatctatgtgccggctccgtttgcggcagatgcgattatggaagcggtcgatgcagaactcgatcttgtcatctgtattacggagcatatcccggtattggatatggtcaaagtgaaacgttatatggaaggaaagaaaacgcgcctgatcgggccgaactgcccgggcatcatcacgccagacgaatgcaaaatcggcattatgccgggttatattcataaaaaaggccatgtcggcgttgtttcccgttccggtacgctgacttatgaagccgtccatcagctgacgcgcgccggcatcggtcagacaggggcgatcggcatcggcggcgaccctgtgaacggcaccaattttattgatgtattaaaagaatttaacaatgatccggaaacggaagcggtcattatgatcggtgaaatcggcgggacggcggaagaagaagccgccaaatgggtgcaggcaaacatgaagaaaccggttgtcggatttatcggcggtgtcaccgcgcctcctggaaaacggatgggccacgccggcgccatcatttcaggcggcaaaggaaccgcagcggaaaagatccgcacgatgaacgaatgcggcatccaagtagccgaaacgccggctgtcattggggaaacgctcgttcgtgtactgaaggaaagaggcctttacgagaaatgtaaaaacctttaagcggcggcaccggccgtcccggaacccgcattttccgggacagtccggtaaaactgcctggatccggctgccatttttaagcgtgcagccgggtcctaaatgtttttctttttcaatgaaatacggtttgaaagcgaggcaaacaatggaaccattaaaaatcaaatacattcatttggatcattgcaggggaatttcccgcgtgcaaaaaatgaaaatcctcgaatttgatccgctgcttgaaaaaatctgccggattccccctgaaacactgcgcgccatgcttcatatgcaaaaggaaacatttgaacgcttttatgaagatcttcttcatcttgacatcaaaccctatttaaccctctaccagaaaaaacagatccgaatgacagcccgttttgaaccggaatatccgccgcttctgaaagaaacgtaccagcctcctgccgtactctattcaatcggaaatgtatcattgctgaaaaaccgtgcgctggccgttgtcgggtcaagaaaggccggttcctatgcagaaaaagtcgccgatcatttgctgccacccctgatcgaaaaacagtttgccattgtcagcgggctggcgagaggggcggattcgattgcccaccgtgccgccatgaaatacggggggaagacgattgcggtgctcggaagtgggttttttcatatttatccgcgggaaaatatacaaatggcggaaaaaataaaacagggccatttactgctgtcggaatatccgccgtttacgcgcccggaaaaatggcgttttccggaacgcaaccggatcatcagcggcatttctgaaggtgtgctcgtgcttcaggcggaaaaacggagcggctccctgatcacggcagattacgccctccaggaaggccgggaagttttcagcgtgccgggaaacgtgctggacagcctgtcgaaaggaacaaaccatcttatccagcagggcgcaaaattggtaacatgcagcggagacattttggaagaactgcttccgacaaggtaaaaaatagttagagaaaattcataaatgggcagtgattttccgattttgtgaaaaaacgcatgatttttggataaaatggttataaaatagagaaagaaaagataaaattttcaaaatgaaaccgcttgcgatgttgatttttcatcattcgtgctgttacaattgacaaatgcgggcatccatgcccataattacaaatgattttgtttgaaaaatgaaagcaaagttgctgcaaagagagggtataagctctccagggaggatttttgaatgtcagactacttagtgattgtagaatcacctgcaaaagcgaaaacgattgaaaaatatttgggaaaaaaatatagagtgaaagcttccatggggcatgtgcgcgacttgccgaaaagccaaatgggggtggatgtggacgaccattttaagccgaagtacattacaatcaggggcaaggggccggtcttaaaagatttgaaaaacgcggccaaaaaagcaaaaaaagtctatcttgccgccgaccctgaccgcgaaggggaagcaattgcctggcatctcgccaacagcttgaatctggatgtgcattcggactgccgcgtcgtgtttaatgaaattacaaaggacgcgattaaagaatcatttaaacatccgcgcccgatcaatatggaccttgtcgatgcccagcaggcaagacggattttggatcgtctcgtcggttataacattagcccgcttttatggaagaaagtgaaaaaaggtttgagtgcgggtagggtacagtccgttgccgtccgccttatcatcgaccgggaaaatgaaattaaatcgtttgtgccggaagagtactggacgattgccgggtcctttaaaaaagggaaagacacgttccaggcatctttttacggtgtggacgggaaaaaaatgcagctgaagtcagaagcggatgtgaaaaaaattaccggcatgctgaaaagcgacaagttccaggtttcttccgtcatgcacaaagagaagaaacggaatccggaaccgccgtttacgacttcttccttgcaacaagaagccgcccggaagctgaacttcagggcaaagaaaacaatgatggtggcccagcagctgtatgaaggcatcgaccttggaaaagaagggactatcgggctgatcacgtatatgagaacagactcgacccggatttcggaagtcgcaaaaacagaagccaatcaatatattcgggaaaaattcggggaaaactatttgcgccaggaagaaagaaaagagaaaaaacagacaaatgcccaggatgcacacgaagggatccggccaacaagcattttccgggatccgggttcggtcaagtcctttctaagcagagaccagtataagctgtacaaattgatttgggaacgctttatggcaagccagatggcccctgcgatactggatacgatgagtgccacgctggcaaacggcacggttttgttccgggcgtccgggtcaaaaatccagtttccgggttttatgaaagtgtatgtggaaggttccgacgaccagcaggaagaaggcgaacgttatttgccgcatctcgaagaaggggatgttgtccaatctgagtcgatcgaaccgaaacagcatttcacccagccgccgccacgctataccgaagcccggcttgtcaaaacgctggaagaacttggaattgggcggccgtccacctatgcgccgacattggatacaatccaaaagcgcggctatgtggcgcttgagaataagcggtttgtcccgacagagctcggcgaaatcgtgctcgaattgattcgggaatttttcccggaaatcatagatgtcgaattcaccgctgatatggaaaaagacctggacgaaattgaagaaggaaaagtaccatgggtccaaatcattgatgcgttttatcaaaattttgaagtccgcctgaaaaaagcggaaaccgaaatggaaaaaatcgagatcaaagatgaagaaaccggggaaatgtgcgagctgtgcggaagtccgatggtgtataaaatggggcgttatggcaagtttatggcttgcagcaattttcctgattgccgcaatacgaagccaatcgtcaaaaaaatcggcgtcacttgcccgaaatgtggtaaaggtgaaatcattgagcggaaaacaaagaaaaaccgcattttttacgggtgcgaccgttatccggaatgtgattttgtctcttgggataagccggttggcaggaagtgcccgaagtgcggcgacatgctcgttgagaaaaagctgaaaaaagggacgcagatccaatgtgtgcactgtgactataaagagcagtcggtgaagtaatgatcgaccttgccggaactttggcggccttgcgtggagcgggcggcaaagttccggttgatcaaaatgaatatttacatttttacgagaaaatgcatcttattcttttacttcttggagcagctgttgtaaaatgcttaaaggacagttgcgacaaaaaacgacagaattcccgaatcgttggcgggcagcggccaaaagcttttcaataaacggcattcccggcttttcacggcaggaagcgccagtcaaaaggacaattcgaaaatttatgaaaaatatgtaacattcgttgcaatccgatccggaaatgtgttatgatttaaccggatttccgaatgccgtcccttggcttcgaagcatatgagccggcgggagacggggtttcggttggcgcaagccggggcttacggatacccggaccggcgcaaaaagcccggctggcgggtttgtccgggccgttttaccggctgaaaaaaatggcaataaccccggaaagcctattgttgtctatcaacgtgaagagtggcgtaaagcaggcccgtttccccgcacatgtgaggtgttaaacagatgaacggcgaactgtccggctatttgctttcttttatggaatacatgcaagtggagaaaaactattccgcatacacaatcaaattttatcgcctggacctggaggatttttttgcgtttttaaccgcacaggggattgcctcgctggacgaggtggggtatccggcagggagactgtatttgacaatgttgcatgaacacggatacagccgcgccacggtagcacggaaaatatccagcattcgcagttttttcaaattcctgatgcgggagagaatcgtcaaagaaaatccctttgcacttttatcacagccgaaacaacataagcgcctgcccaaatttttttatgaggaagaaatggagcaactgtttgcggcatgtgaaggcgatgatgcactgtcccggcgcaaccgtgctttgctcgaaatcctgtatgcgaccggcatccgcgtgagcgaatgcgtcaatattcggttgcaggatattgattttgaattcgagacgatccatgtaaaagggaaaggaaaaaaagaacggatcgtgctgttcggccattttgcaggggaagccgtttcggattatatggcgcatgcacggaaaacgttgatgcgcggtaaagaagaccatccctatttatttgtaaatgcacgcggcggcgcattgaccgataaaggtgtccgctatattttaaatgaaatgatcaaaaaagcggcactgaccggaaaaattcatccccacatgttgcggcatacatttgcaacccatttgctgaaccatggggctgatttgcgcacagtacaggaccttcttgggcatgaaagcttgtcttccacgcaagtctacacacatgtaaccaaggagcatttgcggcaaacttatatggcttaccacccgagagcatagcaatgcaaggcggttcgctttgattacataggaggtgctgatatgggtgattttcacgcaaccacaatatttgccatccgccataacggaaaaagtgcaatggctggggatgggcaggtgacgctcggaaactctgtcgtgatgaaaaatacggccaaaaaagtccgccggctgtttaacggaaaagtgctggccggttttgccggctcggttgcggatgcttttacgctttccgaaatgtttgaaggaaaactgcaggaatataacggcaacctgacgcgggcagcagtggaactggccaaaatgtggagaagcgataaagtgctccgaaagctcgaagcgatgctgattgtcatggatgaaaacaatttgctgcttgtctcgggaacgggggaagtcattgaaccggatgacggcatcctcgctatcggctcgggcggcaattacgcgctcgctgccggccgtgcactgaaacggcatgcggcagagaacttcaccgcaaaagaaattgcgcgggcttcccttgaaatcgcatctgaaatttgtgtatttacaaattcaaacattatcgtggaagaactataagcggaaaggttccggtaccggtatatttccataaaggagtgagcggattggccaacacgtttagaaaaacaaacagtttgacaccaaggcagattgttgagcgcctggaccagtatattgtcggccagaaagaagcaaagcgggctgttgccgtggcgctcaggaaccgttacagaagaagcctactgtctgaaaaaatgcgggaagaaattattccgaaaaacattttgatgatcgggccgaccggtgtcggaaagacggaaatcgcaagaagaatggcacggcttgtcggtgccccgttcgtcaaagtagaagccacgaagtttacggaagtcggatatgtcggccgggatgtggagtcgatggtacgcgaccttgtcgagacggctgtccggcttgtaaaagaggaaaaaatgaacggcgtgcgcgatcaggcggagaaaaatgcaaatgaacgcctcgtcgatttgcttgtcccgtcgcggaagaagcaagggaatttcaaaaacccgtttgaaatgatttttggcggcggcgggcagcaggacacggcaccggatgaagaggaggaagaatactccaaaagggaacagaaacagcgtatacgggaaaagctcttaaacggtgaactggaagatgaaccggttaccgtggaagtggaagagcaggcttcgtccatgtttgatttgttccagggttccggcatggaacaaatgggcatgagtgtgcaggacgcgcttggcaatctgctaccgaaaaaaacaaaacggcggaaattgccggtcagggaagcaagaaaagtgcttgcacaggatgaggcacagaaactgatcgacatggacgaagtgacccaggaagccattttccgggcagaacaaaccggcattatcttcattgacgaaattgacaaaattgcctccaaaaacgggaacgggtcccaagcggacgtatcgagggaaggcgtccagcgggatattctgccgattgtcgaaggatcgacggttgtcacaaaatacggctccattaaaacggattatattttgtttattgctgccggcgcttttcatatggcaaaaccgtccgatctgatccccgaactgcagggacgattcccgatcagagtggagcttgagaaactgaccgtcagcgattttgtcaaaattcttgtcgagccggataatgccctggtaaaacaatatattgcattattggaaacagaaggtatacaaatagaattttctgacgaagctattaccagaattgctgaaattgcttttgaagtgaaccaaaataccgataatatcggggcgagaagacttcataccatcatggaaaaactgcttgaagatctgtctttcgaagcaccggacatccatttggaaaaagtgtccatcaccccgcagtatgtggacgaaaagctcggtgcgatttcacagaacaaagatttaagccagtatattttataaccgttttgaaaaatcggataagggtagacgtgtaatgaaggctttctctcttttgcggcaggtcccggcaattcaatgcagttcaaataccgaatcaatctaggaggaatggaaatgagtttgttagataaaacaaggaaaattaattcgatgttgcaaaaagcagccggacgtccggtgaattttaaagaaatggcggaaacgctgagcgatgtgattgaggccaatatttacatcgtcagccgccgcgggaaattactcggtctcgccatcaaccagaaaattgaaaacgagcggatgaaacaaatgtttgaagaccgccagtttccggaagaatacacgaacagcctgtttaacattacggaaacctcatccaatttgacgattgaaagtgagtacacggcatttccgattgaaaacaaagacctgtttgaaaaaggcctgacaacgattgttccgatcgtcggcggcggggaaagaatcggtacgttgattctggctcgtcttgagcgggaattcgatgacgaagatcttgttttggcagaatacagtgcgacggttgtcggcatggaaatcctccgcgaaaaaacagaagaaattgaagaagaagcgcgcagcaaagcggtcgtgcaaatggccatcagttctttgtcctacagcgagctggaagccattgagcatatttttgaagaattaaacgggaaggaaggcctgcttgtcgcgtccaaaattgcggaccgcgttggcattacccgctctgtcatcgtgaatgcgctgcgtaaactggagagcgcaggggtcattgaatcccgttcccttggcatgaaagggacctatattaaagtattgaataacaaattcctcgttgaactggaaaaagtccgttctaactaacggataagctttacggcaatttgcgccaaaaaaggatacgattcgtatccttttttttattggtatttaatttaccataaaaacacataaataccaatatatagatactgataaaatttaaggaaatccgaccttccaatagtgtttcctagtaattgtaaatttttgtaatcctaggtgtattaaggtgcttgaaaaatttttcggcatctttttcgcggtgtgggagtaagggattaatccaaaagtcctactatcaaaaaaatttttttgtgatttaagaatatgttcatttacagcccgttatgaaataattaaaataaaaaatagcaaacaatttgtcgtataaaagaaaaaaatgtcaagtttatgtaatgaggtgtccattgatgagtctctcttccaatacgttgcggtcgcttgagcatgcattgcagtatgcttcgctccgacagaaagtgatttcaaacaatattgccaatgcggatacaccgaattataaggcgcaggatgtcagttttaaaaatgtgctggaggattcggtcaatgccatttcagcgacccggaccgacccccggcacttccgtttttctgccggggattcaagttcagaaatcgtgacggaatccggcaccacttacaacagcaatggcaacagtgttgacatcgataccgaaatggcgaaccttgccagcaaccagatttattacgagtcactgattgagctcgaaaagggaaagctctcatccttattaaatgttgtgagaggaggacagtaagatgtccatgttcaccggaatgaacatttcttctgaagccttatcggcacagcgcctgcggatggatgtcatctcttccaatattgcgaacgctgatacaacaagagatacgtatgtaaatgggaaatggcagccataccgccggaaagaagtggtacttgctgcaggaggcggttcttttgcctccatatttcgttcgaaactcggaatgcagggtgctgggtccggcgtccaggtggccggcattgtcgaagataacagcgattttaaaaaagaatacaatccggatgatcctgatgcggatgcaaacggatatgtgacaaaaccaaatgtggatcttttaacggaaatgaccggtatgatcagcgccacccgctcgtatgaagccaatgtcacggcgctgaatgcttccaaagcgatgctgatgaagacgctcgaactcggccaataacagagaaaattccgcatatgaaaggaggggaatgatgtgtctgttcaatcaatcagtcagacgccgttcgcaagtttgagcgggctgtcgccaaaatcagcaggcgccgcttcgtccgctaacggctccgtttcattttcggacctgctgaagcagtctgtcaatgaactgaacaaacagcagaaccattccgacaccttgattacaaaactatcgaacggcgaaaatgtggacctgtaccaggtaatggtcgccgtacaaaaagcaaacctttcaatgcagacggcgctcgaagtccgaaataaagcagtcgaaggctataaagaaatgatgcagatgcaagtgtaacgttctgatccggcgtacataaaagccgtttcccggccgtaacgcccggatcctttccgtctgccctaaaggcgaaaaggatgccggaacgtttgctgtccgactgttctattgatgaaacaccgtgaattttttatcccgggggataatgatgaatgaaaagttaaaacaatcttttcaaaacctgaaggggttttggaaaagcaggagcaagaagcagaaaacaatcggcatatccgccgttgcccttatgctggtacttgctgccggaatcacttattttatgacaaaaacaaaatacgcgccgctctacagcgggctggatgtctccgaaacaggatccatcaaggacgaactggaccaggaaggcgtaccgtccaaaatcacggatggtggcaaaacgatcgaagtgcctgaagaccaggtggacgatttgaaagtcacattggctgcaaaagggctgccaaagaccggcagcatcgactattcttttttcagccagaatgcaaaattcgggatgacagacaatgaatttaacgtcgtaaagctcgatgcgatgcagacggaactggaaaatctgattgaacagatggacggcgtcgaaaaagcaaaggtgatgatcaatcttccgaaccaaagcgtcttcgtagccgacagccaggcaaaagcttccgcatcggttgtcctgacgttaaaacccggttatgaattggaccaaaaccagataaaagccgtttacaatcttgtttcaaaaagcgttccgaatcttcctaccgataatatcgtcattatgaaccagaattttgagtactatgacttaaattcttcaaattcttccggaaatgcttatacacagcagcaggcgatcaaaaaacaaattgaacgggatattcagcagcaggtgcaaacgatgctttccacactgatgggtgcaggaaaagcggttgtcaccgttacagcggatatcgattttacgcaggaaaaacgcgaggaagatctcgttgaaccggttgataagacgaatatgaaaggcattgaaatcagcgccaaaaaaatccaggaaacataccagggtacaggcgcagcagccggaacgccatctggcagtacagattctgtcggctcttcgtatgtatccgggtcgaacgggaacgggacgtattccaaaacaagtgacacgatcaactacgaagtaaaccggattaaacggaaaattacagagagcccgtacaaaatccgcgatctcggcatagaagtcatggtcgagccgccggtcagaacaaaacggtcttccttgcccgcttcccggttaaaagatattaaatcgatgctttctacgattgtcagaacgtcgattgacaagtcaagcggcacaaggctgaccaatcaaacggttgccgataaaatcgcagtttccgtccagccatttgcagccaatgcgccggagaaggcgaaaaaagcttcgattccgtggtgggtatacgcgattggcggaggtttgcttctcgtgatagccgggctcatcttcttcatgatccgcaacagaaggcgggccgcttcggaggctgaagaagagatggcggaagaaacgccggaaaaaccggcaccgccccgcattccggacgtaaatgaggaacaggaaaccgacgcttcagcaaggcggaaacagcttgaaaaaatggcaaaggaaaaaccggatgagtttgcgaaactattgcggtcatggctttccgaagaataggagggaaacaagatggcaagtaaagaaaaaacgttatccggcaaagaaaaagcagccattctcttgatttctctcggcccggacgtatcggcatccgtctacaaacatttaacagaagaagaaatcgaaaagctgacgctggaaatctcaggcgtcagaaaagtcgacaatgaaacgaaggaaaaagtgctgaccgaatttcaccatattgctttggcacaggactatattacccagggcggaatcggttatgccaaaatgattctcgaaaaagcactcggcccggaacaggcggcatccatcatcaaccggctcacttcatcgctgcaggtgcgcccgtttgattttgctagaaaagcagatgcggcccagattctgaattttatccaggatgaacacccgcagacgatcgccttgattctgtcctacctggatccggaaaaagccgggcagattctttccgagcttccgcctgaaatgcagggggacattgccagaagaattgccttaatggaaggcacatcccctgaaattatcagcgaagtggaagccattttggaaagaaagctgtccgcgacggtgacacaggattatacgcagacaggcggggtggaatccgttgtcgaagtgttgaacggggtcgatcgtacgacagagaaaacgatccttgactcgctggaacagaaagatcccgaacttgccgaagaaatcaaaaaacgaatgtttgtatttgaagatatcgtcacccttgacaatcgttccattcagcgcgtcatccgcgaatgcgaaaatgaagacctgcttcttgcactgaaagtctcaagcgacgaagtaaaagaaattattttccgcaatatgtcgcaacggatggccgattccatgaaagaagaaatggaatatatgggcccggtgcggctgcgtgaagtcgaagaagcccagtcgagaattgtgtccattatccgcaggctggaagacagcggcgaaatcattatcgcaaggaacggaggcgacgacatcattgtctaatattattaattgtcgttagcgtcttcctcttcttcgtcttcagtaatgtcgaaatcatccgtgagcagttcatcgtcttcgaaagtttcatcatcatcatcatcttcatcgatatcagaaaactcatcgtcagccaaatcttcgtcttcggccaaatcttcatcttcctcttcttcgtcggcaaaatcctcatcatcatcttcgacgacatcatcgatatcctcaagatcgaggtcctcatcatcaataatgtcctcttcttcctcgacaactttcgcttttttccgcttcgtttttgttttcacggtgtgggtcacttcttcgtcaatctggtcaaccgggtaccaggcgcggagaccccaagtgttgtcccccaggctgataaatctcccgtcaatgtttaagtccgtatagaactggatcatttttctttcggtctcttcttccggcaatcctaaaaccgcgccgatttccgcaagcaagtcctggaaggaagtcacttgtttcttttcctccaatatttgttccgccaactcgataaaagacatttccttcagttcttctttcggcaactgtcgcaagctcacgcgtcgcacaccctttctcattgatcaaaactgctatatggcaggcaaatgctaatctttgcatgatttaatagaaaacatatttaccattatatacaaaaagcaaacgtttatgctagccccgcggccttttccggctttttttatcccggatttttaagcggcccggtgtcctcatcagccggtatgcaagataaaacagaaaaaaagagaggattaaaaaagggatggcaccaagttctttactgtataaataatacccagccagcaaaaaaacgatcataccgctgcatgatagtaaaattttgatgaaagaaaacaaacagtccacatcccttgaaaaaataagcgattgacgagtcctactcccaccttccgcctattcaagcacatctcctatatccttgtccattttacatccatctggtagaaagaaacaacagaattctatgtggaaagaaaatttattttcgtacttgccattgagcgaaagcaaaaaaccggcattcagctgccggttttttgcttttggaagcacacgctgcatttttgtccagcggcaactcctagcggaaaatgctatttgggtcgttcagctttgctggcactgtagttttagctgtatcagtatccaacttatcctttgttggcccggtaacgtttgcaacaatactaaaagaatggccagaacgcttggcacctgcttcagtcggaatatataatgctaatatcaatattgtcggtatgagtaaactcacattataattggaatattatgttaaacagattcttttttaaaaagttccatcattatcaatatactggaaacttcaaaattcagagagtagttttacttctcccattttgccagccattcacaaaaaatggcaaccactatgccgcgaggagatctcttctatgaataatgacttacgatgcagatccatacctaaaatgaccatatgaatacatagctcaaaaatattatcgtttttattgaaggagaatattatggaagcattaatagaagctaatcgaatttgtaaaagatataatcaaaagagcagtaacatggaattgaaagaaacatcccttaccattcaaaaaggaaagatttatgtcattgaagggaaaagtggagcagggaaatcaaccttgttaaatattctgggaggaatggagaaacccacatctggaaaagtatattacaaaggaaaatccttttatgatctaaaggattcagaacaggctgctattagaggggaacaatacggatttatattccaatcttttcaacttattccggaattgactgtaaaagaaaatatagaacttccactcatgtttataaataggcatgaaagaacaaataaagtggaagaattagctggatatttagggattgaaaatcaattacataagcttcctgactttttatcaggaggggaacaacaaagagtagccattgctcgggcacttattactgatcccaaaattatatttgccgatgagcccaccggtaatcttgatggagaaacaaccaaaaaaatgatccatttatttacaagtctgtgtaacaaaaaaaatataacactgattgttgttactcacgaaaagaatttattcgaatttccagacactttgtttcttatgaaaaacgggagattgcaggtgatacaagaaaatgtttaatttaagcatgaaaattcttttatcgcgaaaaaaatggttatttctcatcgctggttcaattgccattgttctatcatccgtagcttctatatttattgcttctgaatctgtaagatcagcaattaaacaaaaggctcagaatacttacggagaacataccggtgtgttaacaaatattacagaaacaaaaaaatcattgttgaagagaaataaggggatatcggtaggagtatatcaaattattggtaaaactaaagttagtagtgatagatttgcaacggtgggctggatggataaaaaatcaatattattgggacatttaaaattaataagtgggagatttccggagaagccaaatgaggttgcgatagaatctgcgtatttacaaggccctttaaaaaattggagaatcgcggaaaaaagaacaatcaaaattggaaacagcacgaaaagcttacgccttgttggaatagtaaaaaattattcatcacaatggtcagtagccgaggattttgagaagggtgtcaatgacttcccgaatatatttatatctaaacagttaactaccaattataagaaaaataatagtttcttgttcaaatataacggaagcacaaaagattcgtttgaaaaatcaatagatcttattaatcactatgaccgacaaggcactgttaatagtcgattatttaataacggactaaatcaatgtgatacgatcaggaccttatcgattacatttcaattattaattgtgattctttcactattttctataaacagtctcattttatattttacccaagatcaacataaaaaattgggtattatgaaatccgtaggtgcaagtcaacgagctttataccgcatatacatttaccaagctgttattatttttgttttaagtgccttattttcatttcctatagtatattctattcagtcactaatcattcatttctcatacagagagtatttttctaactttatgctgatgattgaaatggttggaatgagtatattactatacattggattattctttatgatcttatttttattccttaaaaatgttaaggagtccggcacattacatgtacaagaactattgaaccagcaaaatcgtgtaagtttcagcgaacgatataaaagcgtttttaaaggctttcattctagctatggaaaattattagtgaaagaattattttcaaatccgaagcaattctaccttactgtattaattttatgcttttcatctttaacattcacatttacaaattatattcaaaaagataatttgtatggttgggaagggcttaaatccaagtattatttaaactcccaagaagcttttagctttaaaacacaacaaaatttaaaagtattaagtcaccagggattaacctttacagaagctgaagtaaaaaaactggaaaaaacacccggggttttatacatagataaaactccattcatggaagatgtcgaaacgctaattgatcggaaaatgattacaccttccattaacaattggatctttaatgaaaactctgcttataaaacttataataataaaattattattccggatgtaaaatacgttcttctcaataaagacgactggaaaaatattgaggctccaaagaaatataaagatcttgatggcaaagcattcatttataatccagttaacaagaaaaacacaaacgaggataaaatcttagttggaaatacattgactttagtcagattgtataaaacgccaaccggaatgaaaaccagtcaaaaaaagttaaaaattctagatgttattcataaaccatttaaatatagagtcagcccttctgtagaaataaaaaaagatgactttattattttgatggacactcaaaccgcagtaaaatccggtttgttccatgggtttaatgaacttgagatttacacgaaaaaagatatctctcataaagaaaaaatgaatcttgataaacaagtaaaatccttatcgtcaacatttcctggcagcttagtgcagaatacttctcaattaataaaagacgataataaaatttataattatctcaaggtgcttggcatgcttttgttttttgtctctcttatcctcactgcgatttccgtcacgatcatgatctttagcaaatatcaaactcagaagagacagtggggcatttacttatctcttgggatgagtaaaagaaacatcatgcaactcgtttttagcgaaatattcatttatgtttttgtctctatgattttaagtatgttaatttgttgtattggattgataatgttaccgcgtcagtatccccttgttttctattttaaatattttctgttgtctattttaattgaaatcagttttctcattatcgggggctatataataaatcgttccttacaacgtcaatccattgcttctttccttagaagggatgagtaacacgccttggacataaataaagaagcgaaaagctatcgtgatatgatgcaatagcttttcgcttctctttcttttttctaattcattcgcaatatgaatagaacgcgtgtataatcgaaatttttgccagttttttaagaacaatacttcttgcagccggctcctcggatagcataacctgcccgtaataaagcccttagcttattccggccagaacatttgcctgtcggatacgggcaaggcggcgggactttctgttcacatattccttctgtattgcccgccaatttggtagagggtgttggtgatttggccgagacttgcgactttgacggtttccataagctcggcgaaaatattgcctcctgaaaccgcggtttgctttaatttttccagtgcggtttccgcttctgctttgtggcgggcctggaaatcacgcaaatttttgatctgcaaatctttttcttcctttgttgcccgcgcaagctgcatattgttcagctcgtcctcgcttttcgggtttggattcaggaaggtgttgacgccgataatcggaagggcgccggaatgctttctgacctcgtattccatggactcttcctgaattttccctctctgatactgggtctccattgcgccgagtaccccgccgcggtcattgatacgctcaaattcctccaaaacggcggcttcgacaaggtctgtcagttcttcaatgataaatgaaccttgcagcggattttcatttttcgacaatccgtgctcttttgtaataatcagctgaatcgccatcgcgcggcgcaccgattcctcggtcggtgtcgtaatcgcttcatcatatgcattggtatggagcgaattgcaatgatcctgaagggccatcagcgcctgcagcgtcgtgcggatatcattgaaatcaatttcctgtgcatggagcgaccggccggatgtctgaatgtggtacttcagcttctggctccgctcatttgccccgtataaatcgcgcatcacaaccgcccagattcttcttgcaacacgcccgatcaccgtgtactccggatcaagcccgttcgagaagaagaatgaaaggttcggggcaaaatcatccaccttcatgccccttcctaaataatactcaacataggtgaaaccgtttgcaagtgtgaacgcaagctgggaaatcggattggcacctgcttctgcgatatggtatccggaaatcgagaccgaataataattgcgcactttatggtcaataaaatactgttggatatcacccatcatccggagtgcaaattcagttgagaaaatgcatgtattctggccctggtcttcttttaaaatatctgcctgcacggtgcccctgaccgtctgcaacgttttttcgcgcacctccgtaaattcctcgacggttaaaacgcgcccgagctccgcttctttctttttcacctgctggtcaatcgccgtattcatgaacattgccagaatgaccggcgccgggccgttaatcgtcatggaaacagaagtcgaaggcgcacaaaggtcgaaccctgcatacagttttttcatatcatcaagcgtgcacacacttacccctgactcgccgacttttccgtaaatatccgggcgttcgtccggatcttcgccgtacagcgttaccgagtcaaaagccgtgctcagccgttttgccggatcatcttttgataaataatggaagcgtcggtttgtccgttccggtgtcccttcccccgcaaactgccgcttcggatcttcttcctgtcgcttaaacgggaaaacgccggccgtaaaaggaaatgcccctggcacattttctttatacaaccattttaaaatctcgcccttgtcttcccaatccggcagcgccactttcgggatcgggagcccggacaagcttgttgttctgatcctcgttgtgatctctttattgcggattttgacagtgaccgtctccccgctgtatttttgctttacatccggccagcttctcaaaagggttttcgattcttctgtcagccctttttccgcttccgcacgaagcgcttcaagcgatgcgatcacatcctctgctgccccggactcctttgcagccgtaatggcgccttcgagttgaaacattctccgtgcgagcattgcctgtgcctccgcctttttatggtaccggcggacggtttctgcaatttcccgcaagtaatggctgcggcttgccgggatgatggtatgccggttgcccgcttcctgtttttttgaaaaagacgagcgaaaagccgttccgctcttttcattgattttttccatcagggcgccatataaggcgtttgtgcccggatcatgaaactggctggcaatcgtaccgtataccggcatctcatccaggctttgatcaaacagcagatggctccgctggtactgcttttgcacctgctttttcgcatcctctgaacctttccgctcgaatttgttgatcgcaatgaggtccgcgtaatcgatcatatcaattttttcaagctgggaaggcgctccgaattcgctcgtcatcacatacatggcaacatcggaaacattcgtaatttcggcgtccccctggccgatcccgcttgtttcgatcaaaatcaaatcaaagccggcagcctttacaatccggatggcgtcatggatggcaagggaaagttcggaacgggatgccctcgtagccatgctccgcaaaaaaacgttcggatggaaaatcgcgttcatccggatccggtcgccaagcaatgcgccccccgttttttgcttcgtcgggtcgaccgaaagaacggcaattttactttccggatggtcatgcaaaaagcggcggatcagttcatctgtcaaggaactctttcccgctcccccggtaccggttatgcccacgaccggcgctttcttcacggccggaatggcagattcaagggcagcaagcgcctcctgatggttcaaatggttctcggcataagaaatcagcctggcaacagaactgatccgcccttcgcttaagcgcccggcttctttggcaaaatccgcttccgttaccgtcgggtggtcgcactcccggagcatcatattgatcatgccctgaaggccgagctttctgccgtcctccggtgaaaaaatacgcgcgatcccgtagtcatgcagttctttcatctcacgcgggatgatgacgccccctcccccgccgtaaatgcggatcccggaggcgccgttttcctgcagcaaatcatacatatacttgaaaaactcaagatgccctccctgataggaagaaacggcaataccctggacatcttcctgaatcgccgcctggacaatttctcgtgccgagcggttgtggccgagatggatgacttccgcgccgcttgcctgcaaaatcctccgcataatgttgatggaagcatcgtggccgtcaaacaaactggacgctgtgacaaaacggaccgcatgtttcgggcggtaaacctctgtttcagccatcatatcccccttgtcttcatcaggattaagttaaaacgcatgaatgaaccccgggatggaaaaacggaaatggcgccaaaaatttatgccatcataccccttgtctcaaggccggaaaacagcaaatgggtttgcagacggatataatcctcaattgtaaacttctttttaaatgcccagcggcggaaagcccacatttcaccctggacaaaaatattgtgggcgagcatctccatctctttttcatccagatcaagttcaccgttttccgcgcattttctgatcattttttcaaatatgccaaccatctccatttcctttttcaatacatatggcagtgcttcttttgtcagtgactttgcttcctggtacatgacaagcacttcatcttgcagttcgtcaacaatccggaaataatgggcaatcgcgagtttcaaactttcaagcgtcccctgaccggcatcaatgcgaatcagcctgtcgcgcacttcatcataaatccggtcgcacaccaaatagaggacatcctcttttgcccggatatattcataaagcgtcccgatgctaaagccggatttcttggcaatttccctcgttgtcgtccggtggaaccccttttccttaaaaagcgcgacggcggcattgatcatttggtttctgcgcttttcaatcagcctttcatccctgaccgatgccggcacaaactttttttggctcacaaacggcctcccctctccgtcagtcctttgtcaacattcttgaaataacaagccgctggatttcctgcgtcccttcgtaaatttgcgtaattttggcatcgcgcatgaaccgctcaaccggataatcttttgtatagccgtagccgccaaaaatctgcacggcttccgttgtgactttcatcgccgtatcaccggcaaacagtttggacatggcggattcttttccgtacggcagcccgtttgattcaagccaggccgcctggtacgttaacagccttgccgcttcgactgcagtggccatatcggcaagtttgaaagacacgccctggttcgctgcgatcggtttgccgaattgtttccgctctttcgcataagctgtagccgcatccagtgcgccttgggcaatgccgactgcctgggccgcaatgccgttacgcccgccgtccagcgtcatcatcgcgattttaaatccctgtccttcttccccgagccggttttctgccgggaccatgacattgtcaaaaatgatttccgttgtggtagaagcccggatgcccattttcttttcttttttgccggttgaaaacccgggaaaatctttttcaatgataaacgcgcttgtaccatggtgtttgcttttcgggtcggtgagggcaaacacaatgtaaatatccgccacgccgccgtttgtaataaaaattttggagccgtttaaaacatagtggtcgccttcacgcctggccgttgtcaccatcgcgcctgcatcggaacccgaccccggctccgtcaagccgtacgcaccgattttttccccgcgggcaagcggaacgagatatttctgtttttgttcttctgtgccgaatttaaacagcggccagctggcaagggaagtatgtgcggaaagggtcacgccggttgaggcgcacacacgcgacagctcttccaccgcaatgcagtatgccagaaaatcgctcccgatcccgccgtactgctccggccatggaatcccgggcaggccgagcgccgccatccggtcaaagatgctacggtcaaaccgttcgttctcatcgcgttccgctgctgtcggtgccacttccttcacggcaaaatcgcgtaccattttccggatcatttcatgttcttcacttaaacgaaagtccatttttctgcctccaatttttttatccaagacaacttaaagccttttctcccgcaataattgattgctgatcacgattctttggatttcacttgtcccttcataaatttgcgtaattttcgcatcgcgcatgaaccgttcaaccggatagtctttcgtgtatccatatccgccgaaaatctgaacggcttcaatcgctgtatcaacagctgtttgggaagcgagcagtttggccatcgccgcttcttttttgcagcccaggccgttgctccgcaaaaaggctgaccggtagacaagcagtttgctggcttcgatgtttgttgccatgtcggcaagtttaaaaccggtaccctcaaatgcgtggatgggttttccgaactggcgccggttttttgcgtattgaagtgccagttcataggcgccttccgcaatcccgagggcctgtgccgcgatcccgatccggccggcatccagcaccgccattgcgatcttaaacccttccccttcttcccccagccggttctcagccggaacctggagattttcaaagtgaagctggacagtttttgacccgtgcagccccatttttttctcatccttgccggtccggaaacccggcatggtcttttcaataatgaaagcggtgatgttgccgtcttccgtgcgggcaaatacaatatacgtatccgcctcgccgccgtttgtaatgaacatttttgaaccattgagcacataatgcccgccctgttttaccgcttttgtttttaaattcttcgcatccgaccccgcctcggcttccgtcaggcaaaaagcccccaggtattccccgcttgcaagctttggcaaatatttttgtttttgcgcttcacttccgaaatataaaatcggcgcggtcccgacggatgaatggacggaaaggatgacgccaatggtcgcgctggctttggaaatttcatgaacagctataacgtatgcagtaaaatccagccccgcaccgccgtatgtttccggaatggtgatgcccatcagaccgagggttgccatttttccaagtatttcacgcgggaacatgccgcgctccatgtcgcccgtagccggcaaaatttctttttctgcaaaatcccgtacggtttttcttaacaaaagctgttcttccgtaaactgaaaatccatgatcaggtccccttttttgggtggtcatacacgttgaagttttattgcacttcaatcatgacggcatcgccctggccgccaccggagcagatggctgcgatcccggtcccgccgccgcgccgtttcagttcgtatgcaagggttaaaataatgcgcgtgccgcttgcaccgatcggatggcctaacgcaaccgcgccgccgtttacattcaccttatccaaatcgagctgtgcgattttgctgctggcaagggccacagcggcaaatgcttcattgatttcaaacaaatcaatgtcatcaagctttcttcctgtttttttcaggatttcgttgatcacaagccccggcgtctgcggaaaatgctgcgcttccaccgccacttctgcatgcgccacaatatttgcgagcggtttcaatcctgcttttgcagcccgttcagcactcattaacacgagtgctgctgccccgtcattcacgcctggtgcattgccggccgtgatggtcccgtctttgtcaaaagcaggcggcagctgggacagtttttcaagcgtcgtatccgcgcgcggcggctcatcctgttcaacaagcagtgcaggaccttttctttgcgggatttctaccggaacaatttcttcggcaaacttgccggaatggatcgcttccaatgctttctggtggcttcttaatgcccagcggtcctgaaaatcacgggtcagcccaaacgtttctgccgtacggtttccgtatgtgcccatatggacgccggaaaatgcgcagatgagtccgtcatgggtcatcatgtctttcagctggacatcgcccattttcaatccccatctcgccttaggcaggaagtaaggggcgtttgacatcgactccatcccgccggcaacgataacttccccgtctcccgcgcggatgatctggtccgccatggtcacactcctcataccggaagcacacactttgttcaccgtttccgttttaacttcccacggaatgccagcgtgccttgccgcctgccgggatgggagttgcccctggccgccctgcaggacattccccataatcacttcatctacttccccgttttcaacgcctgctttttccaatgcatgccggatcgcaatcccgcctaacgcggacgccggaagtgcagccagttttcccccgaatttcccaaatggcgtacgcgccccatcgatgatcaccgtgttcaaccaacttctccccttttacaatggatttatgataagcgccggccatttgcgcgaacgctaatcatcgttcattcatcgttcctttgccattcgttgccaaacagcagtgagccttgtcatgtttttggtatgggtaaagagcacctctgaatcgcgtaaatgcgcgatcaccgttcattcacttattctttttccatgtacttccaaatttgcaacgaacctcccgatgcttttaggatgggtgaaaagtgtctcccaatcgagcgaacgctcaatcatcgtttaatcatggcccttttgccattcgctactaaaaacagcagtaaagtcttgttatactgcgtgatttatttaaaagcgccaaaaaacgtatgaacgcttatatctccaaaccactatcattctgtgtgatctgccgcaaaaaagcggcggagaacctacccaaacttttacatatcccgttccccgccgtttttgcgcagatgatttgccggtttaaaatctaccatgatctgcttttcctgccgagcatcccgttttgcggcggcatcacccgcttaagaaactgcagccgtctgccccggcgccccgcagaccgaacgttccagaatttcggcgacatccaaggtttttacagtgtcttccacttctttcgcttttgtgccatcagaaagcattgtcaagcagtacgggcattccgtgctgataacggtcggattcacagcaagtgcctgttccgtccgcgccacattaatccggtgcccggtatcttcttccgtccacattaatccgccgccagccccgcagcacatcgctgtttcacggttccgctccatttccacaagctttacgcccgggatcatttttaaaatgtcacgcggctggttataaatatcattgtacctgccgaggtagcaggaatcatggaaggtaaccgtttcattgacttcgtatttcggctttaagcgcccttctttcagcagctcgtaaagcacttcggtatgatggtacacttccccttcaaagccaaaatctttatattctttcttaaatgtattgtatgcatgcggatcgatcgtcacgatttttttcacgccgttcttttcaaactcggcgatgttctgaccggccagttcttggaataaaaactcattgccaagcctgcgtgccgtgtcaccggagtttttctccttgttgccgagaatggcgaatttcacgcccgcttcattcagcagtttcgcaaacgactgcgcgattttctggctgcggctgtcgtaagaccccattgatccgacccagaataaatattcgaattcctcatctgctttcttcatttctttgaccgtcttgacctcgatatcttcgcgcccttcacgccacgtttcgcgctctttccggttcagcccccaaggattgccctggcgttcgatattttgaatcgcccgctgtgcatccggcttcatttttccttccgtcaaaacgagatagcgccgcaaatcgatgatcttatcgacatgttcgttcataaccgggcactggtcttcgcaattccggcaagtcgtgcatgcccagatctcttcttctgttatgacatcgccgatcaggctcgggttataatcgagcgctgcagctgcctcttccgccccgcgacttgcactttcccgggcgagcctatttcctgtcgtgttggcaaaagcaaacgccggaacccacggtgctttagacgtaacggccgcgccgtagttggtcaaatggtcccttaatttaatgatcaagtccatcggtgaaagcatttttcctgttccggttgccgggcacatattcgtgcagcggccgcattccacacaggcgtaaagatcgacaagctgaagctgcgtgaagtcctcgattttgccaacgccaaaactttcctgcgattcgtcttcaaaatcgatcggccgtaatttcccggtatccccgagccggttcagatacacattcgcaggccctgcaatcaaatgggcatgcttcgactgcgggatatagacaaggaaagtaagcagcagcaacagatggatccaccatgccacgtaaaacacaacggccgctgcagttggtccaatccaatgaaaggccgctgcaatcccggctgccaccggttccgtccatgacggctcctcaaagtgccaaatgatttccatgccgcccccgaccaggacagaaaccattagcccgccgataaagatgagcacaagccccgctttaaaatcgcgttttaagcggacgagcttctcaatgtagcggcggtaaaacgcccagccgaccgcaaataaaatgacgagcgtaacgatttcctgaaagaaagtaaatccggggtaaagcggcccgagcggcaagtgcgaacccggtgccagccccttccatatgaaatcgatcgcgccgaactgaacgagaatgaacccgtaaaacatcatcacatggatggcaccgctctttttatccttaagcagttttttctgtccgaaaacgtatacccaaatttttttgagccgcgccttgacattgttgtcgaattcctgttttttccccaacttgatatactggatccttgtccttaccaaatacacaaaaaggccgattccgtaagcggttacagacaggaacaacagccagttcaaccataataagatgtgcatttttctcccgacgctcccttcattcatttatgctcgcacaaaaaagcaggtaattttccgaatcttgcttacctatattatataatgaatgagcattcagtcaatccttttttctttatttttttgaatttctttgtgcctgtttccggcttttgtaagtagaatcggccgcatttggggaagaataaagacatggactcggccacggaaaaaatcgattgaagcggggaaaaaagatatgattttgctcttattcctttctgccgtcatagtactcatcatctggcttttcaccgattacacgcttggaaaaaggcatttccgcaaaactcgcaaacagcgccaatatcccgtacggcacggagattttactgtttttacatgcggagaaaatctgtttccccactacttttccgatatcctgcatgccaaaaaaagcatatacgtcctgttttatattgtaaaaaatgatgaaatcagccgtgaatttttcagcctgctcgcaaaaaaagcgcgcgaagggaaagaagtaaaagtattgctcgattgggcgggcagccggaaggtcacaaaacagatgattgcacagctgaaaaacgctggcgcctcgtttgccttcagcaaccggccgaagttcccttttttcttttacacgctccagcagcggaaccaccggaaaataaccgtcattgacggggagacaggctatcttggcggtttcaatgtggggaaggattatatcaatggcaacaagtcgctgtctccttggcgggattaccatttccgcttaaccggcggaagtatccgcgacttgcaggaggaatttatcaggaactgggaaacggctacaggagaaaatatgccatttgaaacacatctctctccccatgaggagaaaagcggatgccgccaccggatcatcccgactgcgggcgatgagcttgagcacctggtttgcagcctgattgatgaagcccgtgaatcgatttttatcggttccccgtactttatcccgactccggccatccacaaaaaactggtacaggctttggcacggggcgtaaaagtcacagtgctcacccccgataaggcggaccatccgcttgtcaaagaggccgcaagccgctatttccggcagctgcttgaaaatggcgcagacatttatttgttcaagcccggattttatcacgcgaaaattatgatcattgaccggaccgtctgcgatatcggaacggctaattttgaccggcgcagtgtccgtttaaactttgaagtcaactgtcttgtatacgacaatgcgtttatccaaaaaatgtgtgcgattgtaaaagaagatatgcgccacgctgtcccgcttacagcagacgacctgaaccgccccggattggcaacgaggctggctgaatggggtgtgagggcaattgaaggatttttgtgataaaagaccggctctgggtcagtcggcgcgatcaaaaaaaattgctccctgaagactggggcactgccaggcacattaggtggttaacagctaaaccatcgtttgggctgtccttgaataccatcgccccttaaaagctgtcacggaaccccaggcacgtaactgcacgtcatcttgctatttgcattccattttgcttttcttaaacccaataaaccattgcgcaccaaaaaaagccgccccctgaacctgtaaacggatggggacggcttttttctttacattttttccggtgcggaaacgccgattagctggagcgcatttttcagcgttatttgcacggccttcacaagggcaaggcgcgctttggtggcgtccgcatgcgccgggtcaatcactttcacagcattgtaaaagctgtggaagttggccgcaagttcgttaatataatttgtgatgcggtgcgggatccgcttttcggccgcttccgcaatcacctgcgggaattctccaagttttttcaggacatccgtttccttttcagaccggatcacggaaaagtcggcatctgtatccggcgcaaaccctttttcttccgcctggcgcaaaatgctgcaaatacgggcatgagcatattgcgcatagtaaaccgggttttcattggactctgaaacagcaagatcaaggtcaaagtccaaatgcgtatccgaacttctcatcgcaaagaaataccgggttgcatcgagcccgacttcgtcaatgagttcccgcatcgtaaccgcttttcccgtccgcttgctcattttcattttttcgccgtttttatacaagtgaacaagctggatgatctccacttcaagattatcgctgttataaccgagcgcttccatggccgctttcatccgcggaatatagccgtggtggtcggcgccccaaatattgatcaacgtatcgaatccgcggtcaaatttgtctttatggtaagcaatatccggggtcaaatacgtgtaagtcccatcgtttttgatgagcacgcggtctttgtcatcgccgaaagccgttgagcagaaccatgttgccccgtccttttcataaatatggcctttttcgcgcatcagcttcagcatttcgtcgattttcccgctcttgtaaagagacgtttccgaataccagacatcaaaacgaacgcggaaatcttcaaggtcttttttcagtttggccatttcgtaatcaaggccgtactggcggaaaaattcgtaacgcgttttttcatccgtgtccacaaatttccggccgtattcatcggcaagtttctttccaaggtcaataatatcctgcccgtaatagccatctgccggcatttccttttcaattccgagcgcctggaagtagcgcgcttcgactgacagtgccaaattgtggatctggttgccggcatcgttgatatagtattcacgggtcacctcataccctgctttttctaaaatattgcacagtgaatccccaacagcggcaccgcgcgcatgtccgaggtggagatcgccggtcgggttcgccgatacgaattcgacctggatttttttacctccgccggcatctgaacggccataatcggcgccatcgtgaagaatagaagggatcagccgggtcaaatacgtattgtccaaataaaaattgataaagccggggcctgcaatttccactttttcaatcgaagttttcgatttgtcgatatgttcgacaatcgcttccgcaatctggcgcggtgctttttttgccgcgcgcgcaagctgcatggcaatgtttgcggcataatcgccgtgtgctttttcttttggcttttccagcacaatagccggaatatccgcttccgcaaccaagccggttttcatcaccgcttctttgatttccgttttcagcgtttcctgcatttgttccgcaatgttcattttgctgcttgtacctcctcataatggatcttcattttatatgtaccgaccgaatccccatgcatataaagcctatatccgagggaaagctgcccggaaagcgagcctgtacgcgtgtgcacaatctcatctgccgccgcttcaatcgggaattggccatagccgttttcgtaagtccccgggcgcctggagccttcacgcaaatcaagccgcatggagaccgcaccgcttctcattacaagcgcccttccgcttgccactttgacaaccgtatgaattttgccggcttcctgcatttcctcgtactttaaataggccgaaccgcctttttcataataatggccgaacaaaaccagttcgatcttttccgtttcttcctggaaaatctccgtggtcatatgtatttttacggggcaagaaacggtttcctccgccattttcccacatcctttatttcatccattataacctttccggcggaaaaataatatgcatactctccttattttatcatatataacgaagctgccatcccgcaagctaaactttaaaaacccggcaccggctgcaggggcaggtgccgggttttccgttacttcacccagccaagcatcatttcgcgcacgagcttgctagccgtattggctgtttgctcagaatggtcgtatacaggcgccacttcaacaagatcacaaccgatgacattcacgttagaacgggcaattgcatgaatcgatgccagcagttcttttgaggtgatcccgccggcatcaaccgtccctgtccccggcgcaaaagccggatcgagcacatcaatatcgaccgtcacatacacatggcggccggaaagcgacggcaacacttttttgagcggctcaagcacttcaaattttgcgatctgcatgccgtttttttctgcccattcaaattcctctttcaagccggatcggatcccgaatgaatacacattccgaggtccaattaactccgccgttttccggatcggcgttgcatgcgaaagcggctcaccttcataatccgtgcgcaaatcggtatgggcgtcaaaatgaatggcagcaagatccgggtattttttgtaaacggcgcggattaccggccatgtcaccaaatgctcgccgccaaggccgaacggaaatttcccgtcgtcaagcaatgtcccgacataatcctcaatcatatcgaggcttttttgcggattgccgaacggcagcggcatatcgccggcatcaaaatagctgatttcagcaagttcccggtcaagatacgggctgtattcttcaagcccgatagaaacttcccggatgcgccccggaccgaatcttgaacccgggcggtagctgacggtccagtccatcggcatgccgtaaagcaccacccggcttttttcataatcagggcttgccccgataaaaacatggcctgaataagcttcatcaaatctcatctttttctcctcttttcacaatttcggacacatggaaaaagtatagtgaaattccgaaaaaaagcaagaatctttttacagcgggccacccttcccataatccttttttcggttccggtgtttaaaatttcctctcttactaaatactaaggaaataaggagaaaaagaggtgcggatgatggagacacagacaacaccaaagatccggaaagccaaatggggcctgcgcctgatgctgtttgccctgattactttcgccatcctgctgtccgtcttaacggcagctgtctatctgtatgcaaaaattctcggtccgccgccgctgtccgtgccgcaatcaacgctgtattatgcacaaaacggcaaacaaatcggcgagtcgaacagcggccagcaaagatactgggtgccgcttgacggcatctccgaaaacgctattgacgcgaccatttcaatcgaagaccgcaacttttaccatcaccacggttttgattaccggcgcatggccggggcggtcgctgccgatatgaaagcaatgggaaaggtgcagggtgcaagcaccattacccagcaatacgcccgcaacttgtttttaacgctcgataaaacatgggaaagaaaattaaaggaagcgttctacacgatccggctcgagtccagctacagtaaagaccggattctggaaggctatttaaatacgatcaattacggacatggaaaatacgggattgaagccgcaagccggtactatttcggaaaaagcgccaaacagctgacgcttgccgaagccgccatgcttgccgggattccgaacggcccaggagtctactcccctgttatttcgccggaaaaagcgaaaaaacggcagcttgctgttttgcaatcgatggtgaaaaacggctatattacaaaaaaacaagcaacagcggccgccaatgaaacgataaaaatcgtgcaaaaagcggatccggatacaaaccggattgccccttatttccaggaccttgtaaaaaagcagctgaaaacaaaactcgggtttgatgaccggacgatcgcgctcgggggattaaaagtgtataccacccttgatgtaaagcaacaagaaattgccgaagaaaccgtgaaggaaatcattccggcatcttcacacatccagatcggttttgcggcaatcaacccgaaaaacggctttgtgacggcactcaccggggggcgtgactatgcggaaagttcctttaaccgcgccacacaggcaacgcgccagcccggttccaccatgaagccgctcctttattatgctgcattgaaccacggattcacgccggcaacgatgctcaaaagcgaaccgaccgttttccggccgggcggatcttcatacaggccgcataatttcaacagccagtatgccaatagggacattacgatgatgcaggcgctcgccgtttcagataatatttacgccgtgaaaacccatttgctgctcgggcaagatgtgcttgtccaaaccgcaaaacaattcggccttacaaccccgatggaaaaagtgccgtcacttgcgctcggcacatccggcgtgcacctgctcgatatggtgaacgcctacagcctgcttgcaaacggcggcactcaaaacgggcctgttttcatcacaaaagtggaagattataaaggccgcgtcctgtatgcatacgacaaacacgagaaagaacgggtgttggacaaagcggcggcgtttgtcacctcgcaaatgatgaccggcatgtttgacaagcgcctgaacggctatgcccgtgtcaccggcgcctccattgtcaaaaacctcacccgcccgtacgccggcaaatccggctccaccaacacggacagctggatgatcgggttttcgccccagcttgtatcaggcgtttgggtcggatacgacaacgggcaggaaatcacgttggccgccgataaaatgtacgccaaaaaaatatgggcccggtttatggaaaaggcgcttgacgggcgccctgtaacggaatttaagccgcccaaaggcgtaaccggtgttgaaatcgatcctgccaccgggaaaatcgcaaccgctaactgcccggtggcaaggctgacatactttatatccggtaccgaaccggccgagccctgcagcaaacatcccgctgcaggagaaaatgagttgtacccgaaaaagcaccggaactggcttgaaaaactgttcccgtttttttaaaacagcaaacagaaaggcctggccgctgtgcggtcaggcctttcctgctccttcaatgcatcgtgaaatttcggccggttccttacgcaaaaataaatgcgcagggtcaggcctttaatgcttctttcaattcatcgctggataagttccacatctcgctgctgtggccttttaaaaagtctgccagcaccttcttggaccggtcatccatatggtctacaatgatatggcccttcatcgacttgtcgaggcggttgacatgctctggcagcgatttgtagccgcgacgtttttccttgttgaccaccatttcgcaggctgtcaccccgtgataataagggccgttttcgccgcgttcaattgtcacccacacaagccagtacggttttgccccctcttccgggacttccgaacggtcgggggaaaatctcacccgcttttccacggcgctccttgcatgcatcgccccaatatcgacaaccgccgtaccttcattgacatcaatgatcaccggcgagacattttcaaggtttagcgccccggtgccaaaacttttatggccgtcggtcggcgcatttttaataatattaaattccgcttttttctttttttcagccatcttgtacatcccctttctctcaatggcagtctatccgaatacggaaacaatcgactggaatcccttcataatcgacgggaccgcactgttaatcagcggcgagatcgtataccggccaagcggcgtgataagcaggaccagaaatacaacgatgctgtactgctcgtactgcgtcagttttgcccgtacccccggcgaaaccaaatcttctatgatccggtacccgtccagcggcggaagcggaattaaattgaaaataaacaatacgagattcagccagacaaaataattgaaaaaggaaaggacaaaccatggcaggcctgcgccaagcccggttgccacgagcacataaaaaatgatttccccgataaacgccattaaaaaattgctggcagggcccgcaaaggataccgtcacccctgccaggcgcggatttttgaaatggtagcggtttaccgggacagggcgcgcccagccgaagccggcgacaaaaataagcagcgcgccgagcgggtcaatatgctgcgccgggttcaatgtcagccgtccctcgcgtttggcagtcgggtcgccgcacagataagccgtataagcatgggaaaattcatggacggtaaaagcaatgatcaacaccgccgcgacaatcgggatatccctcaacggatatgccaaaaactgttgtaattgttccacgtaccggtctcctttaaaaacaatatattgactatagtatacaaaattttcattcggtattcacttgttttaaaagtgccacttgcaggcgggcaaaaaagactttacaatttttatgaaatcatataaaaggagatgcacccgcatgccatatgtaaccgtcaaaatgctggaaggccgtacagacgagcaaaagaaagcgctggtcgaaaaagtaacggccgcagtcagcgaaaccgtagacgccccgaaagaaaacattaccgttttcattgaagaaatgtcaaaaaaccattatgccataggcggcgtccgcaaaagcgacgaataggggatgaaaaatcgctaagcctgctggacgggcctggcgatttttttcaatttttctatgtaatcgtacgcctcgttgatttcctcctccgtataacgctgcttcgcctttaatgtaaagattttctcctttacttcctctttcggaagcatatcaaaatacatgacggttgaaacgagctcaaggaaacgcgcattttgcccgttcatttctgccaggcacgcatccagccctggcagatccggttcgtacatttccagaaattcccggccttcgtctgttaccgtataccgatattggacatatccgccttttttctcttttacttcgtttacaaacccgaggttggtcagctcctctactttgagcgtcaactcttcagaatacgggccgtaaaaatgaaactcgaatttttcctgaaacgggaaagataatttttttgcaatataaatcattttttgcagctttttacgcccgacaatctctccgcttatggcaagcgcacccataatttttacatgatcttctaacacaaaccattcactcctgactaaatttccgaactccggggcagtttcagcaaagcagcaatttcccttttcttttccccgtgtgtcgtttcgtcttcgatcaaatcaagcggaaaatacaatttatgatccgtccttcttttccccgaaatcgcgtccacaatatccgattcccttgataattctttcaggtcaccgtttcgcatcagcaaattgatcggcagccgctccccttcctcgcccggccggtaaaaatcgtacggaagatctgaagacgaatcaatgactaaataatagttcgggtcgatcccggcttctgcaaaaagcttttcaagccggctgtgcaccttaaattcttttgccgggtcaaactcaatgtatttaaacagattccggtttacaaagcgggcgcaaaggtcccgcaaaaccgggtcatcttcttcctgccaaacttcaatataatacagcatgacgtgctcatccagctttaaataatcattcaggctgagtctaccttcaaaaagcgactggaaatggctgggcccgtgtttgaacgggtaacgggcatcgtacaacgtttttgcgcggtgcaaaatttttgttaaaatcacttccgcgcttcttgtcaccgggtgaaaatacacttgccagtacatttggtaacggcttaaaatataatcttcgaccgcatgcatgccgctgtatttaaaaacagcctggtcttcatgcggtcgcataacgcggagcagcctttcaatgtcaaaatggccatagctgacccctgtataatacgcatcgcgcaacaaataatccatccggtccgcatcaagctggcttgaaatcaggctgaccaccaatttgttttctgaagttttcgcaatcacttccgccacttttttcgggaaatttctgccgacccgccgcaatacttcattgacttccgtctccccgaggatgatttgccttgtaaactcctcatggtccatgccaaacactttttcaaacgaatgggaaaacgggccgtggccaagatcgtgcaaaagcgcagcgcaaagcgacagcagcctgtcctttccgttccagttcacccggtctttaaaaacatcatctgtaattctcctgacaatttcatagacgccaagtgagtggctgaaacggctgtgttccgccccgtggaaagtcaggtaagtcgtgccgagctgccggatccggcgcaatcgctggaactcttttgttccgatcaagtcccagatcacccggtcacgcacatggacatagcggtggacagggtctttaaacactttttcctcactgagcttaagtttggcgtattccatgctttaccctcttcctgatgtcgtaattctattataccgggacaagccggagaaaaaaagcttgtaatatgcggataggcagcctttaaaatgtggaggtcgattgacaagtttattttttccgaaaaaaaaaccaataaaagggcgcatctgcgaaaatacgggactccgcacgttgaaccaggtatcaacggctgcattaaaagggcgtatcgatgaaaatgcgggatgctgccctttctatctgctgcatcaggttgcaatggctgcattttttaaaacctttgcatttaaagccaccagaatccttgcctaggcaatcttaatgggctttttggcttcccgtgtgtgccccccaactgtgttgctacaagcaaaaatccgtttgtgcgctaaaattctattatttttttaccatattggtataaattgcgtgttttttgtccattctcttagtacaaacaaaaaatttacattttgggggtaatgagaatgaaatcacgtcaagatgcgtggagcgaagaagatgatttgttgctggcggaaacagtgctccgccacgtgcgcgaaggaagcacacagctgaatgcttttgaggaagtcggcgataaactgaaccgtacatccgccgcctgcggtttccgctggaatgcggttgtccgccataactacgaacaggcgctgcagcttgcaaaaaaacagcgcaagcaacgccaacgcctgcttggaaaagaccagggcgggaaaaagaaactgctgtaccagccgccggttccaacactcgaggaaattggcgaaataccgcttgctgaatttccggaacaaccggctccggacggggaagaagctgaaaacagcagccctcaagtttcccaggcggccgaaaacagcggggaaatgagccttgtcaaggtcatcagctatctgcaatacttgaacaatacgcaattccaaagcacgattttaaaaagtgagaatgcaagattgaagcacgaaaaccaggaattgaaaaaggaaacggaagaattgaaaaaacgcgtcgaagagctcgaagaaggttcggttaccatgcaggaagactacgaaaccttgatgaaaatcatgaaccgcgcgagaaaatacgtccttttcgaagaagacgaaaccggggcaaccaaatttaaaatggaccgcaacggcaatctcgaaaagctggcagaataagtttcgggcgagtaaacacaaacacccattgggcgatgcatgctcaatgggtgtttggcgtgcaagccggcaatctcccagcttttgttgcatgaaaggataattgggacgttccctaggtgccttttggcttttaagatgttctaaaggacagtttgtttgattcacaggcgctttttgtctttttgagatgttctaaaagacaatttggacgctgtcaaggtgtcttttggctttttgagacgctctaaaggacaattggcacgtttccccagcatcttttggctttttgagacgctctaaaggacaattggcacgtttccccagcatcttttgtctttttgaaacgctcctaaaaggaaagtttggtcgccgcccaagtgtctttttggagccacgtcttaaaaatgtctttcattcgttttatgaaagacaaaacacaatcgcctcaaccccaaaatgtccttcattcgtccgatgaaagacaaaaaatgattgccaccgctttaaaatgtccttcatcttgtacatgaaagacaattgccaaccagccgcgcttcaaaatgtctttcatccactttatgaaggacaaaacagagaccatctccgaccccaaatgtctttcatccactttatgaaggacaaaacagagaccatctccgaccccaaatgtctttcatccgctccatgaaggacaaaacaaactcgccataaccctaaaatgtccttcattcacccgatgaaggacaaatcaaagacattacagaccccaaatgtctttcatctgcccaatgaaggacaaaacaaactcaccataaccctaaaatgtccttcattcacccaatgaaggacaaatcaaagacatcacagagcccaaatgtctttcatctgccccatgaaggacaaaataaagtcgccacaaccccaaattgtccttcatgcgccagatgaaagacaaaaacagcctaccatcactttaaaatgtccttcatccacttcatgaaggacaaatcaaagtcattaccggctccaaatgtctttcatccactccatgaaagacaaatcacaatcatcacgaccccaaattgtccttcatctcgcacatgaaagacagcaggcaaccggccacgtttcaaaaatgtctttcctcagatcagcaggtggcccttgatcgttcattcttcacaaaaaccgtgcgtttctttccagcatgcgttcataatatttgccgtaccattccgtttcctgttccgaaagcggacgggacacaagccggccccccaacgtcttcagcgtttgcaaaagccgcatgaacacatcctgaaccgtgagtgtttcctgtaaaagctccgccaaagaagccatcacttcaggacggacacatgggtattgcaactttgtctccgcaccctgttttgcccgctcataaaaatcccgaacgagttctgccctgtcggcgccgcttcccgtcacacacaaataaatctggacggccacccctctcctgacccgccgctgggagatgccggcgaattttttcccgccaatgctcaaatcatagctccccgggcagtacgagcctgctatttcccctgcttcaatcacaaccggaaaatccgaaaacatcatttggaccagcttccacatcgcttcgtaaccacggttgatatccattcccttttccgtatccgggaccacaagcgaaatgttcagcacgcctgtatccaatacaacggcaagcccgcccgaattacggacaatataccggaaccctctatttttaagaacagcaagcccctcctcaaaaaagggcaattttgtatcctgaatgccaaggctgacggtgtcgtgatgcacccatgtccggacaacagccggggatgcatttgccccgacagcggtgcacaatgtgtcgtccatcgcaaatgactgggccgcttcaaactgcgggcccaacccggactggtccatcacccgccactcgggctgcttcagcaattgcagcgcttcttccatgtcgatccttcccccatttattttactactatcatatcatgccggattgactatcacatcaaccaaaaagctgctgccaaaacccctctattggcaaggattcgagaacagtactgaaccaatacgcacacaaatttccaatcgatcaagttcaggccaacatttttccttttctccgcaaatttttccattataaaaagcctttcctccagccgtataaaacacaaaaaaggtttggcatcatccaaaagccaaaccaaaaaaggcgagcattctaagccctggtgtgcaagctggaaaagaagagcctcggccacataccaaggtcattttcccccgcaatgtcccacagctttacttcccttttccgttcgtacccattctttgcacatcggtacacccttttttcgtttttgttaaaaaaatcacaaagcagccagacgcagacattaccggtaatttgtcagccggacacctcccaaaaaatcaacacgcccttctacaaatgctgtccaaccaaccgacaagactgctgtcacggttcagattcagccggttcaaacatataagggattcagtatagggttgagataagaaggctgctttccaggaaaaaaacctaaataaaatgaacttaagtttttcgcgtccaaaattcattacaatcaggttagacattgattctggcaacactgaaaaaataatattggtttgttcaacttatataagcctcttttttagttctcctcccaccgctgtccattcaacagccggaagcctggcaactcccttacaaactttgtgctgcggaaatcaaagccaaatgataaacatcttccgcattgcagccgcgcgacaaatcgttgacaggcgcattcagcccttgcaaaatcggaccgactgcttcaaaaccgccaagacgctgggccattttataaccgatattccccgcatccagatttggaaaaataaacacagttgcattcccctgaatcacggaatccggcgctttcttttgcgccacagccggcacatacgcggcatcaaactgcatctcgccgtccatgacaagctccggatcgcgctctttagccaatcggactgcctgcgccactttctccgtctcatcggaatgggcggaaccttttgttgaaaagctcaacatcgcaatcctcggttcaatatcaaatgtccgggcagttttcgcgctctccacggccgtttccgccaagtcttggctgtccggtgaaatattgattgcacaatcggcgaaaacaaatttctcttcgcccctcaccataatgaaaacgccagaaacttttttcacgcccggttttgttttaatgatctgcaatgccggccggactgtatctgccgttgaatggatggcaccgcttaccagaccgtccgcttttttcaaatagacgagcatggtgccgaaataattgacgtcttttaaaatttggcgcgcatcttcctccgtcgctttgccttttcttcgttccacaaaagcctgcaccatttcttcaaaaccggcatagtcttccgggtcatacactgtaacgcccttgacagaaacaccgatggcctgggcttttgcctgaattttatccttgttcccgattaaaaccggccggagtacttcatcggctgcaaaccgggagacggctgttaaaaccctttcatccgaactttccggaaaaacaatcgttttgttatgtccccgcactttttcttttatcccgtcaaaaaatgtactcacgctcaacactcctcgtttacggtatccattttaaggataatccatttttccggaaaatcaaaggcaaaagaaggcttcttttagacaatttcgcggtagccgtaatattttttcccttttctaacctgtgttatagtaagggaagagaaaaacatttggagggaaaaaaatgagcgaagcagcagaaacactggacggctggtactcactgcatgatttccgttctctcgactgggcgggctggaaggcgctgcctgccgaggaaagggatgctacggtgaaagaattccggcaatttcttcagcaactggatgccatccaaagcaaacacgaaggggcttatgctttatataccatcaccggccagaaagccgactttgttttatggacgatgcggccggccctggaagacctcgaagaaattgaaacagcctttaataaattaaggattgctgattttaccattccggcatattcgtacatcggtgtaaatgaactgagcaactatgtgcgcggcgggaaagcggacgagtctgcgtatgaaaatccgcgtgtccgcgagcgcctctacccgacattgccgaaatccaaatacttctgtttctacccgatggataaacggcgcgaaggcaatgacaactggtacatgctgccaatggaggaacgcaaggagttaatgaaaagccacggattgatcggccgcaaatatgccggcaaggtaaaacaatatattctcggttccaccgggcttgacgactacgaatggggtgtggctttattatccgatgatgccctgcagtttaaaaaaatcgtctatgaaatgcggtttgacgaagccagcgcaaggtacggagaattcggcccgttctatgtcggcagcctgcttgacgaagaacggttaacctcctatttgcatattggttaagaaaaatccttccagcctgctggaaggattttttcacgagagatcttaagcataacccgtttccggccggcatacacataaatgtagtgaatgcccttgttttttgtgcattttacaaaaaccagggcagaccgatatgcaaaatggagggggaaatcagttggaaaacggcaattacacaccgcccgtatacggatatccttattattaccggcagtccgcacagccttattacggaggatattatccgccgtaccaggttcccggggggcagcaagcgcaggcaccctcacagaacctgcccggccagcttccgcttgaacaatcgtatattgaaaatattttgcggctgaataaaggaaaactggtcacgctgtacgccacgtttgaaaacaaccgggaatggaatgctaaagtgttcaatggcattattgaagctgccggacgggaccatgtcatccttagtgatccgcaaaccgggcagcgttatttaatcccgatggtctatgttgattacgttgtcttctctgaagaaatcgaatatgaatacccatatggcagcacaacgcaggccggtcagccgctggcaacctatccgccgcggtgatcagcgaaagaaaaaacagctccgaaaccgggctgttttttcttacatccactttaccgccgctatagcaagcagtatccaggaagcaaggaacgcgacgcctccgattggcgtaatcgcaccaagcacactgattttcgttaagcttaaaacataaaggctgccggagaaaaggacgatgccaatcagcatcaaccatcctgaccagctgagcagtgcggatgatttgaggatgccggaaagaatgccgatcgcaatcaacccgagcgcatggtacatttcataacggacgccggtctcccaaatatccagatacttctgatccatgatccctttcaacccgtgggccccaaaagccccgagcgcaacagatatacacgcgttcagtgctccaaaaaaaacaaaaatattcatgcgatgcactcccattttttcatgtaaaacgctgtagaagcttaaaaacaagtcaacataaatgttcatgataaaaagctagataccctgataggtatacaaaccgtataagaaactgcagagaagacaggaacgcctgctttggtggacgcttgtttcaattgtttgcgattaaaaatcaaaaatagagtctccgtttgcaccatcttccattttcaacggctccggtttcagcaccgttttcggcacagaaggactggcaggcaatggctcttctggctgtaccgcctttccgctttccaataaaacttcacacaaagcttttaccgcatagatatgctccctgaattgttccgccggcattgcctgttttgcctttgccaattcctgctccattttttccaaaagcatttccgttgtaatggccatttccgcacctctgtttaatttctatataaaataaatgaaatctgttgcctactgcaaaaaagtatgagcaatgaatataagtttttccccaagcccgcgttccatttgcacgatgacattttttccgaaggcaacagaactgcgatattttattcattttatatagcctgaaaatttgttttcatcccgctgctgtgatgcgttccctgtagcataggcgtccaacctgaaatttgtaatcgctaggttcatgacttccgatcgcatcatggctgcagggtgccggtcctgacaatgtttccttcctttgctggcccgcatttgtcgtttgcttacatttattttaacagaggccaattgtccgaacaatgcggaacgctgtcataccttgcaaaaaaatcgccatgtttcacgtggaacattgtcggatttccgcgatggaatgcgttttatatcttttcctgttccggtagctgccagtccacttctttttctcccaacttgcgcaaaatattattggtttttgaaaacgggcggctcccgaaaaaaccgcgatgggcggacaacgggcttggatgggcagcggttaaaacgaaatgtttgttggtgtcgatcagcgcttttttgctctgcgcaggccttccccataacagaaaaatgacaggtgtttctttcgcattgattttccggatcacttcgtctgtaaaaatttcccatcccattccttggtgtgaatgggcctgcccttccctgacagtcaacacggtgtttaacagcatcacgccctgcttcgcccagctgaccaggcacccgtgctgcggaatcctgcatccaaggtcgtcatgcagctctttgaaaatattccggagcgaaggaggaatatccacccccggctttactgaaaaactgagcccgtgtgcctggcccggtccgtgataagggtcctggccaaggaggacaaccttaatatcccggtaagccgtatagtggaaggcattaaagatatcgtacatatcaggatggatccgctttgttgcatattcttttttgaggaactccctcaattttaaataatatggtttttggaattcctcctttaaaagcgggccccaatcatttttaaaaatgtccttcattccatttacagcccctttctttcttatactataattttaacagtttccctgtccggcggctgtaaaactttttttgtttaaggacagcaggaagcggttatataaatgtcaaacagaatcatcaccatttttcggaaggaggaaaacagatgcataaagtagaagttgtcgaaaacgggctcgaagcgacgaataagataacagagtttgaaaacgaaggattttcgaaagacaatatttatattttctcgcatgacaaaaaccggtcaaaagatttaaccgatgcaacggaaacgggatcggtcggcatggaagaacaaggggtcattgattcggtcggcaatctgttcagggagcgtggggatgaactgcgttcgaaaatgcagtcgctcggactgtcagagatggaagccgtacagtatgaaaaagtactcgacgaggggcgcgttgtcgtcatcgccacggataaccaggaggggcctgaacacctgctataaaaccggaccgggccggcgttccttaagccggcttttttctgcttttattaggttaaatggctcatattcagccatcctgggacgtgtctttaaaccaggccaattaaactaacagttgcaaaaattataaaaacagatcacttaagagagacaaaaaactgtcagctgataattctagtctgctcaatatgtaaaaaaaggtaaacagactgggtagtacttgacctttttcaatccgatgaaccgttttttcggataatatgttgcctgcaagatccttttgcgtcaaacccttttctaatctggcagtttttactgctacccctacattttcggcatttatgattttttgtaaaaacatttcctctgattgaaattgtttgtcttgatataccatcagctcccaccccatatgatttgagtattctatttttgatttacaagttttgatttacaagcttatcatttcaaattaaaaaaacgaacaattaaaaattcaaatcaatcacaaaatctttcgatactttttattttaataaattactgactgttgtcaacgaaaaatttttcggcatcactaaagatatatgctgaaatctatcagacactttttccaaaagctttacttcatcacccatccttctgttttcaggtataactggacacatgtgtctattgtcaacaaacacacattttaataacatacacttgaacaaattgataatttccaagcaataaatgatataaatgtgcataacatttatataaaagttattaaaataggcccttcgggttaaattaaaataataaaaatattaaattttaaaaatgcaactaatcccgagggtctacttttaaaagggaggtgaatataatatgggattattccacgttgcatctaagtttcatgtttctgcaggaatagcatctggtgttgttacagctgtattgcatgctggtactatagcatctataataggagccgtcacagtagttatgtcaggtggcgttgatgcaatcctcgatatgggatggacagcgtttattgcagaagtaaaacatttagctaaggaatatggcaaaaaaagagctattgcttggtaaaaactggaacagccaggatctacagtcctggctgttaaaaaacatttattgatttttattgtggagtgatgtttatggggatttttaggcttgttatgctatatatcataaatacatactcaacccgaggttttttaataaaaaaggtactgaaaataaagagcactaaaaaatacattctattgagttttttgtttgaagtctttatatctgtatttttaatttctatttttaacaggatctttttaccggaccataaaaatattcttattggagtggctctgattctgactgttggcgaccaagtgaaagctgttatgacaacaagaaaaatgttagatgaaaggtacttggtctatcattttagcaggtatctcgggaagaataacaatttaatgaaaaaggttatactgctcgactggatggttagcatggtgcaaagtttaaccaaaatcgtgccgtttggggtgtttttttatttacacaggatgggaacgaagtacatattgattgtgattttgttcgaactgctcctgttttgtattcatttacttggaaaatcgttatcttatcataaaggtttccgtattgtactaaacctgacaacaaaagctttgttatgctgcttcgtttataccgttgcttccatcttcatgcaaatcatttatgaatcaagacgtaacatatctacttatggatataaattaaaagccatcacaaatttaaataatcaagcaaaagaaatacttctaagctcaaatttgtttatcatttttaaaaatgcagccttgtttgttagccatatgcatattctcacggctactttaaccgtggtattgctattcatcattagtattatcatttttgctttctcaaaagatacgaaggaagtttattatcaaacgcccttctttggttttttatataaaacattgaataaggagcactattatacctatgctgactactattctttaaaagcaaactcaaaagaattactgaacaatccttttgacctgtttatcacgggagaactttctgtcagtacaggaatttcattggcctcggcaccttatattcataatatcatcgttacccttatttttatgttttttcagctccacatcattctgaagggagcgataagcactacaagctttatctacaaaaaaatttttaagcttgaacaagaatgttctatgatggaaatttttaaaatatatgagttaaaaaagaatggtattctattctcaaaatatgaattattaaaaagaacgatcaatatatatttattttgtcatttgtttttgttctttattgcaactttgtttatttcgtttcaacaaagtctatcttttttgattttaattccatttttttatgcaataaaaaacgaatatgttttatactcacttagaaccaattatgacgtttttgttttattacttagcaaaagtaatcctcccaaaattaacaggctgaatgaattcgatggattctctttaattgctacagcgaataatgtattatctaagcttgtaacccaatttacaatattagggttgatcataatagcgatgttcaaatttatctcggggatttattggctctgccccttcttggctatcgcctttactctttttggacaagtagtttacagcaacaaggattacaaaaaaatcaaacagtcctgtcaataggtttattaaaacaaaaaataactaaacacggggatttaagaatttatgaaaaatataattaccacatataaaaaatacttttttgtttctttagccgtttattgtattagttttataaccggagcattcttatcaaaatttttaagtttcaagtataccgaaaatgagcaaagatttgttgacctgtttcttcataattatacattggggcttaaaatcatggtattaggttggattagtttgggtgtaattagtataatatatttggggtataatggggtttttttaggtgctttctcatttgcaattataagaaaccatgggctcaaacctgtattaaccggaataatcccacatgggattatagaagtaattgcatttttgctttttgcaacaattggctttgaaagcctgcgttgcattaacattttaaaattgaattctaaaagtgaacaagagttaagatataaagtttaaattataaagttagtatcgatttttcttttcgcaaccattttattggtaattgctgcatggattgaagcggacatatcacatgtatgaacggaagtgaaatagatatggaaaggatatcaataaagcatttaacttatggttatgaaaatcaacccaggttatttaataacgtaaatatcgagatagatcaaaacagtattgtaagattatatggaaaaaacggttcaggaaagactactttgctgaaaatcattgcaaatattatagacgatcctcatctgtcttatgagttgcggttttttggtgaaaagctaagttttgcagacattcgcaagcgtagagtatttgttggagactctcctgtattttatgaagaattaacaatggaacaaaatattcaattttacaatttgttatttcattacggccctgtattcagcaaacaagtatatgaatactgtaaaaagtttgatgttgatgcctataagaatgagcaagtgaaaaatttgtcattagggacccggcaaaaaatctttttatccattaacttatcgatcccttcagaattggtcttattggatgagccgtttaattccttggacacttccagtagaaaagttttatctgacatcatcacacaaagtaagcaaaaaacgtttgttattgtgtcacatgaaaaggaagcaagcctgtctttcacacatgaattaaatagcgaaaattggcagttaaaaagtttaaataacacggatgggggtgtgggagaatgaaatccgccatgttcacgctggtactaatcgccatttttgtttttgtctatattaaaaaaacggggatttcaaatatatctattccaaagttattgtttataccggcgatttttatcgcagcctattttatagacaaaaagttgcaacagaaattacgaaaataagcattcataccagcaatttcctgggccagttgccagattaaacataggtaaaacaacgatgggaatgcacttttagaagaagctggtccggaattgcgcaaattcatcgttgcggaacgcgacgtgaagcaggagcagtttcctcccataaactaaaaacgccgcacaagattgtttcttttcacaaagggcattgaaaaaaaacacccattttgtaaaagaaggatacgtatgccctttttgaagaaaaatgccctttttatttttattgaatttgaaaacctggaaggaaagccaaaaatacgggatcattcattttccagcgcctcgattaagggtaatttttaattcaaataataacatttatggaatcctcatttttatcattttttcagttataaaagcgctttttgcatataatgacggagactatataagaaataccagcagttaataaaacacaaagcacaaaataaaaacctaattttaggttagaagattgatgaaaaaaatttgaaatctttaaggctgaatgattaactttggagagtataaaagcaatcaaaattatcaatatgacagcaatagttaatccgttttgattgaacaagtatataaatggaattaaaataagcatatacattaaagaaatacacagggttaaaagccctataaataagtaagattttaaaggcaaatttttataaaagacatatataattaaattaactaaaaaagaaaaaatgcttgagataagacataacgaaacacccgttaaataacgtgcaaatactatcctattgaaagatacacctgttgtatttagaaagtctaaaaagccggatttattatcatcattaaatagtgactgaatactatttagaaaaagcatagttataaatattgaaattacagcactgtcttggcgtagaaatattattgccaaaattaaggccgctacaaataatattacgaactttaatttaaaccagtgttttcccaataataatatatcttttaaatatccccctatcatattgatcacctccttgctattatattcttcaattccgattccaactcatttgtattacttatatcggaaacatctttttctagtagcatagaacctttatgtaaaaatataaccttatctgcaattttaataatatcgtcaagtaggtgtgtgctcataattgcaatagatgaggttgtctttacatattcctttataatggttaacacagtatccctcattaaagggtctaatccaccagtaacttcatcaagtaataataattttggatggtgggatagagtaacagcaatacccattttggttttcattcccttcgaaaaatatttaatgctttgagtttcgggtatttcaaatttatctagataatccttaaatttttttgaatcccatgatttaaatatatatggcataaataaattaatatttttcgcagataattcctcgggaaaatgattagtgtcaaattgaaaaccaatttcattcttgggaggaaccaaaagttctcctgaatccaaagaaattgtttgagaaataatccttaaaagtgttgttttcccagctccattttcaccaataattcctactatatttttaggaaatgctgaaaaactaatattatttacatgaaatttaccgatttttttagatacagattctaacttgattggatttgtcatattcatttttttcacgctttccctatttaataaaataagttagtgatattgcaattagtacataggaaagaatgtgtgatgtattactattccctgtaaaaataaatgagcatatagttgcaatgaaaactaaaaaaacgataacccttaagatgattgccatattgaagttggactcctttttctacagtctattcgaaacaagcaatgtaagtgttataagcttaacggctgaaaaagcgatgccaaagtacattaacccaacaagtaagcttattaaatttagacacaactaatcctaaaatatatccatagatggattctttttttcttgttaacgtacttggtgaattattttgttaaagtatgatcgatctcctgtgacaatgcaatccgcttattatatttcgaatgaatagaatatatgattgtatagccaatgccgatgatcaaatttaaaattgcaaaaacaatgaacagcatagatatgcttaaattatataaatatccccccactggacctccaaccgagtcacctaccaatacagaagattgaacgattcccaaataaagggttaattcttccgcaggaaacatggtatactccattatttccctcactatttgaaatcctgttatgaggatcgcaaataaaaaaacgggaatgatgatcatatgacgcaaatccattacgccagtaaaagtaaagataataaagattaccaattctattattaaaaagaaaatatttggccgctgattcattttcttattgcgaaagaacaaactgctaagcatttgaacaacagaaacaattgtcatcagcgtactgacaaatgatatattaaattggcctacttcctttaatattatgggcaaataaggttgcactaagccaagattcattccgataaggattcctaaagtatatacaagaattgctatctttttgtttgatggcaacactgttttatttcttgtctttttaataatgtgatcatccggataatcacggatgaaaaaaacaccaaataaaagaatcggagccatgatcaacaaactaatataagatgcactgctctctcctaaaaaatataaggcctgcccactgagaaatgtagtggagatcatagcaatttgagaaataatggcctttgatgatattaattttgaacttatttccggatgatcagctatcagtgcagcgatccaggttcgggtaattaataagaccgttgctgccccaatccctgatacggcgccggaaattatcggaataaaaaacggctggggaaagatcctgagcaacatgcctgccatataaagcggaataaaaataaatatcccttttttaatacttaactgatttactttctttcctaatagaaaactaaatgaacctgctaccgccatggcggaataagataaagaaaaattaaatacgctatcgttcttttcaaaccaaagtatctggatatacttggatacccccatactaaagtaaaaagtaaacaagaaaatggttaacgttttaaatttgtacattacgaaacctctaatttttaaagaataaatagaaggcacgaacaattttgaaattaatcaaataaaatattgttttcacaagacatggttctttatcatgaaattcttatttttctcaagttaaaatatagtacagatgattaaataagtcaatatttactttctattttaaatattacaataccttcttttgaaagccggtcattctaaagttcggttcgcggccctgctgtgtgactggcagatcatcccctgttcatcaagcattcggccgcttgatgcacgcccccgggatttgtatttttcatggcagtattatattctaaaatagtgtaaagcttatttttaaaggagatgggtgcgtgatgggtttaaagaaaacttttacgctggctggttctgattcgagcggcggcgcaggccttcaggcggacttgaaaacattccaggaactcggggtttacggcatgtccgcgattacttccatcgttgcgatggatccaaaaaacggttggcatcataatgttttcccgattgatgtcaatattgtcgaaccgcagcttgagaccatcctttctgtcggaattgacgcgatgaaaaccggtatgctcggttcagtggacattattgaactggccgcccgtaaaatagatgaataccatctcgacaaagtggtcattgacccggttatggtatgtaaaggcgaagatgaggtattgcagccggaaaatacggatgcaatgcgcgagcttttgcttccgcgggcaacgattacaacgccgaacttgtttgaagcctggcagctggcccaaaccggcccgattaaaaccgttgaggacatgaaagaagcagcggtcaaaattcatgaactgggcgcgaaaaatgttgtcataaaaggcggcagagggttggatacggatcaggccatcgacttgttctatgatggggaagattttgaaattctcgaatcgaagaaaatcaaaacaacgtataaccacggtgcaggctgcacatttgccgctgccatcacggccgaactggcaaagggcaacaccgtgtctggtgcagtgaaagtggcaaaagaatttgtccatatggcgattgaacacggctttaagctgaacgaatatgtcggccctgtgatgcacggcgcatatacccgtttctcgcataccaactcttaagtcaaaccgggccctgccggaacattccgccggggacccggtttttaattttttcttaaagtgctgccggttggtataatggaaagaaacaggagcggacggccaaaaggaggaagaaaatggaaccgatacaaaaacaaacagcccaaaaatggctggacgaacttgccggaaaaccggtgtatatccatttggaaacaaccaatggcgcctatgcctcccatgtcaatgagtcatttttctctgcaggcgcctatatccgcaatgcgcaagtatcctatgaacacggaaaaattgttggggacggcccttaccggatcggcttgaaaatgaaaattggctggatttatgcagaaggcctgacccactttgaaaaagatgaattcgaccgcttgctttttgccggccatggttatgacgggaagttggctgttgccctcgaattgagcatgacaccatttgagtgaggagatgagaaaaatggaaaaagagcgccatgttctggtgattttcccgcatcccgatgacgaggctttcggtgtatccggcacgatcgcaacccatgtgaaaaacggcacgccggtcacttatgcctgcctgacgcttggggaaatggcgcgaaatctcggctatcccccttttgccacaagagaatcgctgccgcatatccggaaaaaagaactgcaaaaggcggccgagattatggggattcaggatttacgcatgatggggttgcgcgataaaactgtagaatttgaagacgatgagaagatggtcaaaatggtacttgacctcgtccatgagctgaatccgtcacttgtcattaccttttacccaggctactctgtccatcctgaccacgaagcaaccggaagagccgttgtccgcgcgctccgccgaattcctgaaaacaaacgcccgaaactccactgcgttgctttttccaaaaaccatgaagcggagatcggaaagccggatgtccgcaatgatgtaagcggcgcagctgagcaaaaaatcggcgcaatgaaagcccacctatcccagaccggctggatgatggcagagcgggaagaaaaactgaagcaaaaagacccagaaactctggaatggctccattatgaatacttctggacgtatgactgggaaaacgaccgggtccgataagggtaattaacccataaaggcgccaatcgttgagtcgtgcaaggaactctgcctgccagaccccctgccctcggtttatcaaatataaaccggggcgggggcaatgggttctaacccatttcaagcattctgtaaatcgcttttgccacgccgtcttcatcatttcttttcgtccggtagcggcaaatttccaatacttcattttcggcatttcccatcgcaaacggatagcccaccctttcgagcatggaaatatcatttaagttgtccccgatagccatcgttttctccattgagagcccgtgtttttccgtgtattccttgagcgcaatccctttttgcgccgacacatggttgatttcaatattacggaatcctgatgaagtcactttaatatcgggaaaatctttttcaaggtgcttgccgatttgtcggagcctttgttcatcttcattgaaggccaatattttgtaaaacaaaatggacggatcgtgaaaaatatcctttgtatctcgaatattatggacgtatctccggatgccgcgctgctcaatatagttccgcacttcttccaccggcacttcggggtttgcggtatggaacaaattgaccagcatatccatgttttcctcgtaatcttccgtataggtacctttattggtaaaaaattcataataaatgccgagttggtcgaaaacatcggccacctgggaagctgtcaggggatccagcccgcttgttttgagtaattttcccttttcatcccgcacttcggccccgttcagcccgattaccgtacagtcaatgccgacaggatcgagcacaagccgcgcttcttcataagaccggcctgttgtcacgacaaagtgaatcccttttttctgcgccagtttaatcgcttcggcatttgccgggctgacttcctgccttgagttgagcaaagtgccatccatatcggatgcgatacattcaatcatgatgtcaatcccctccagatatatatgatgctggtttttcttgttccgcatgatgcttcctttcctgtaagaaggcccggatcataaaataactgacctcatccggcaacaattcctttatcggcgttagccgcccggaacctgcccggtttatggcatccgcgattcgctcccggtacctttcgggaataaagcggctccattctaccggaaatccctcgtctgaacatttgatcacatgcgtttcaatcgttctttccgacatgccgcggatttccgcgatttcacggatcgtttttccttcttgcaacaggcggtatgtcacatgatggcttttttctttcccgtcttcatgcaccttttttgtatgcggcaatgctttcggctgcgcttgtgcttgtatcccttcttcttccatgtaagtccggatcacgcgcataaacagctcggcgtactgttccacctttctttccccaacccctttcacctgcaggaacgcttccctggttataggcattctggcactcatttcccttagcgactggtcggaaaagacaatataaggcggtattttttcacggtcagcaatctctttgcgaagtgtccgcagtttttcgaataaaaggttatcggatgcaatttgctgcgccctgacactttctttccggaaaacctgtttttttgaaagcaggacttccactgcctttttggtcagcataagcaccgggtatgtaccgtctttggcacgcaaaaaaccgtcagctgtcagaaaatcaatcagttctgccacttctttttgcgttttgtctttcataatgccaaaagtggacagcttgtcaaaaccgaattgcctgattttctggtcgtttgatccggccagtacttttgcaatcatcgttttgccgaaccgttcctgcatccttttgacacaggaaaaaaccatttgcgcttcttttgtcacgtctgtttttgcgcgggtatccaggcagttgccgcatttaccacatggctgtgtctctttctcgccgaaataatgcaaaatgaactgctgaaaacagccttccgtatggcagtagtccagcatttttcgtaacttggcatactcgcccggttttctgtcttcatttgctgactgctcgattaaaaaagtttgcgtatggatatcttggggggcaaacagcaaaatacagtcgctttcctccccgtcgcgcccggcccgtcctgcttcctggtaatacgcctccatatttttcggcaaattataatggatgacaaaccgcacattgcttttatcaatccccattccgaacgcggaagtggcgaccattacggaaatatcatcgtataaaaaccggtcctgaaagctgtcgcgctccgcttctttcatccctgcatgatattttcccgcacgaatgccatttttaacaagaaaattgtaaatacgttcggtctcttttctcgttgccgtgtaaataatcccggactggtttgcatttttcaggatgtaatccagcacaaaggcatcgcgatcctggcctttcaccacctgcaaatgcagattctcacgggcaaaacctgtcgccactgtgttttcttccggaatctggagcagccggcagatgtctttctttacctgcggcgtcgctgtagcggttaaagcaagcgtcaccggctttggcttaaattgtgaaatcaatttttcgattaaacggtagcttgggcggaagtcgtggccccattgtgagatacaatgcgcttcatcaacagcaataagggagacattgatgttttcgagaagatgtaaaaaaggaggaaattcgagccgttccggtgcgagatagattaatttgtatgcgccttttgatgcagccgcaagccgctcatcgatttctgccgggttcagggaactgttcacatatgttgccggtatcccaatgtttgccagtgtatccacttggtctttcatcaaggaaatcagcggcgaaatgacaagcgtaacccctgataaaagcatggctggcacctggtagcaaaccgactttcccccgccggtcggcatcatgcccaatgtatccttgccatccatgatctggctgataatggcttcctgcccgcggcgaaaatgatcatagccataatattgttttaaaacctgtctggctttatccattgctgccacaaggctcccatcctttccgcaaaatttgcctctattataacagattttgccggggcggtatacggagaaaaccaccccggcagttgtccggcccggtatatattattttttcagccccatcgctctcagcaaagcatcatggatatatgtgttttcataagtgccttcaaacaacgatgcgccgctgcctgtcgccgtgagcgggatatcggctgccgtatggccggaagttgtccagtccacgacaaattgcgcgctggaacccgccacctggaacggcccgtcttcttttgaaatgccgtccccggattcatcgctgtgctcgacgttttcaaccgtcatgccgccgcagtcatggtcggccaggacaagcacaagtgtatccgggtgctttttcgcataatcttttgccgctttaacggcattatccagttgccggcccgccttgatcagctgggaggcattattttcatgggccatttcatcgatcgcttcttcttcaaccatcaggaaaaagccttttttattttttgacagcgtgctgattgctttttccgtcatttgcggaagcgaaacaaccgggtcatactggtcgccatggccctcctctcgctgttcaaacatttcttcattggcaaaaaggcctaaaagcttattcccgcctgcctttttcagcccggaagcatttgtaacatactggtaaccgagccgtttcgctttgccgacaagatttccttccgtgcctttgcttgcttcggaaggatcttttgccggatggtcttcataagcgccctgtgagccttgcgggtaccagtaatcttccccgccgccgagcagcacgtccactttgctgttttccaagtattgctttgcaattttgctctgttcggaacggtttttgacatgggcaccgaaagcggcaggcgttgcatctgtgatttggcttgtcgtgaccaatcctgttgacttgccggcttgcttcgcttcttcaagaacggtctttttgcttactttattggcatcgacaccgattgccccgttattcgttttgacgcctgacgccatagcggtcgcagctgcagccgaatcagtcaccacggaggtggagcttgtatgtacgacccccgcatacggcattttgttcatttcaaggtccccgctcaggccggttgaagcaaggcggatcgcatcccgctgcgcagcccccataccatccccgacaaacagaatcacattcttcgccttcgcggaagctgcatgaccggtgtgttttgaaggcttgtaagcttttgcatctgcaatgccgtatacccccaaagccgccactgcagacaaggcaattgccgctttcatcatacggttctttttacccaatgttcttcctcccctttttcgttttgtgcttacgcctcttattgtaaaaaaggattttgaaggaagtatgttggatttgtaaaagaaagatataaatcttgtgtaggggcttttacaaaattcccgttatcttcgcagcctgaggtattcgtttctcgtttcattgtaatacttcaaaatgtcttcccccttgcgctgaaaaacacttaaatagagcgcgtcaatgatattcagctgcgccattctcgaagacgttgttccgatccggaaatcttcctcggatatcggcgtacaaagcctgatatccgcttgtttatacaatggagatttctccatattcgtgatggcaatcacttttgcccctttccttttcgcaaaatcagcgagttcgagcacatccttcgtccgcccggaaacgctgagcgccacaaacacatccatcttattcatgtaagggattagggagattagataatgataatcttgggaaaaaatggactggcaccccagccttgtaaatttatagcatgcatcgacagcggcagttaccgacccgccgacaccaaaaaacaccacttttctagcattttcaagcacgttggcggctttttccagttctctcctgtcaagggaagaaacacacgattctatcgccttcttattcccatacgtaactttttggaataaatcataaggagaatctttttgttgcaaaattgaaaagtctgtcatatgactttcggttaaagttaaatttttcacaagctccagcttaaacgtcttaaagctcgcaatgccgatcgttttgcaaaaccggacaacgctcgactcgcttacaccggttttttccgataaatcctttgtggtcattgtcggaaccatttcgggatgttccaaaatatatgtgccaattttcttctctgtgcccgtaaagtgatgcatttccttttgaattcgttcaagtattgaatccacaacttttcctccatttataaccatcattggtatacgcgaggcaacaggcgttttcccgcctttacgcctgcctattcaccagtaaagaaaacagcgctttccaacatcatagaatgaaactttttctccgtcaatggcatcggaaaaattctgttacaaccgctttctccctattccctttcgctactttgtatgataaaataaacatcatttcgcaggaaagttacaccatgacttccatcaaggggtgttagcatgccatatatccagcgtcggaatgcgattctggccatgatttgtttgtttcttatgctcagcctttcaactgtatggttttcctatcgtacggacaaaagcaatgccgctgcggccccgccggcacaaaaacccgttccgactgtgttcgtacacggctataaaggaacggcccgatcgtttaatgggatgctcggccggctggaaaaaagcggaaccgctgaaaaagcaatggtgattcgcgttacaaaagacgggatgattgtggtcaatggggaaatttccaaccgggcccggcatccgatgatccaggtcattttttccgataaccgtgcaagtttccggcaaacggccggctggcttgaaaaaaccatgcacattctttatacgaaatacgatgtgaaagaagccaatctcgtcgggcattcgatgggcggtttgatttgcacaaaatatattgaagacacttccggcaggcggcaatatccggacattcaaaagcttgtcacgattggcagcccttatgaaggcgtgctgactcgtgtttttaagcaaaatccgaataataccggcgatgcggcgcgcgacctgcttccgggttccgttgcgctcaaagctttgtatgccaacaaaagccggttcaacccgcatattcaggtgcttgccattgcaggcgttgtgaataagccggcatcgggggattcccttgtatccctggacagcgcgctcttcagcaggttcatcgtgccgaaaaagcagtacacgtctaaaattgtttacggcaaaaacgcgcaacacagcagccttcatgagaataagcgcgtggaccggcttgtcgcggactttctttggcatgcaaaaaaatagaaaaaacggcgaaacctgcgtaaaagcagcaaccgccgcttttttatttagtccgaagaaaccgctttctatttgctgccggaactggttcttcaagtttgattagggcttgctgaataagcaaaatttctagatttggcaaggatgttcacggcttttgcttaaattgaatgcaagggtttataaaaaatacagggaaaagcttgcacttgaaacgcaccctatgtgaaggaagaccttcatttttccgtgcttcctaacgtagacagcctctatgtgaagaaaggccgtcaattttttgttcttccttaacatagacacgccctaggttaaggaaggccttcatttttctgcgcttccttaacgtagacgccctctatgtgaagaaaggccttcgttttttcgtgtttccttaacgtagacagcctctatgtaaaggaacaacgtcattttttcacgcttccttaacttagacgcgacctatgtgaagaaaagccttcaattttccgcgcttccttaacgtagacgggctctatgtgaaggaagaccttcattttttcgtgcttccttagcgtagacgcgccctatgtgaagaaagaccgtccattttcctcgcttccttcacatagggattgctgagaataagcaaaattcctagacttggcaaaaatttaagcttgcacttgaaagctgactcaaagtatagagcagacataatcgcatttccaaagatggattcttctatatttttagacaaatcttgttgacaaattgggtacaaactcagagtcggattcgttcagcaagtccttattaaagttgaagcgatccggtgaaaaagcaatctgccccgtctttgcaagcaaaagaattaaaagcggtccaattgctggtacagtttctttaatgcctgttcaatctccgcgagctgcttttcaagcgggtgaaggttgccctttacatactccaatttctccaaatcttgctgtaggcgaacataatccgctttcaaatcggcaatttggtactctacatcccgtttatccatgttcctcacccccttaaagaaaatgatggaacacgtcacacatttgaaaagtctcatgtccctggcatgcatccttttaatgcgttaaatcagcatagtttgcgtcggcggcttttaaaagatcaccaggcgccaaaacaatttgcgtgccgatccgcccggcgcttacgatcacctcatcaagcgttgctgcgctctcatcgacaaatgtcacatagtgcttcttcatgccgatcggggaacagccgccgcgaatatagccggtatatttttggatatctttcacatggaccatttcgatctttttctcgcccgctgcttttgcggcttttttcaggtcgagttctgccgcaaccgggatgacaaacacataaagttcgccgctgtgcccctgcgtgaccagcgttttataaacagcttcgggcggttttccaattttttccgcaacggagatgccgtcgattttcccgtccttcacctcatacgacagcatgccgtacgggatttgctgcgcatcaagcagccgcatcgcgtttgtttttgttgtttttgccaaattcaccacttcctccagaggcctgttactataagtgtaccggtttcgaggcggattttccatcaaaacaaaaaagccggcctgcatggggcgaggccagctttcctttatttacgcacaccttttttctttttctggtcgatttcatcttttctgcccgtggagaattccacgagttcttctgcaatctcatttccaagcttggcatttttattccgctcagcattctggtttccgtatttctgcctgcccatttgcacgctcctttccttttttacagctatattttgcattgaaaaaggaagaatatgcggcgttttagattaatgaatgatatgggataccatccacggcgtaacaaaaatggaaatagccgcaacgataatcatgctgacgctggaaatggcgcctgaccgggcactgagttcgaatgctttagaagtgccgatcccgttcgcatgcgttccaagcaggatgccgtgggcaatttcgtttttaatgcgcaaatgcttgatcagccacggcgccatcacagagccgataatggcgttcaaaatcacaaagacagccgtaacagacggcacgccgccgattttttcagatacgcccattgcaatcggggttgtgatcgtaaacgggatgatactgtgctccaggcttttgctgaaatgaaaaagcgtagcgatggccgaggaaaggaatactgccatcagccatcccgccccgatgccgattaaaatttcaaccgcatattggcggacgattttaaaatggcggtaaagcggcacagcaaaagcaacaatggccggctgcagcaaatccgttaaaacagaggtgcctttctggtagtcccggtacggtatatcttccccgagtaaaaaggcgcctaataataccggcgtgacaagtagcggggaaacaaagatttttttgtatttcccgtacagttttttgaaaatccagtaacttccaaccgttaacagcaggcacacgattttaacgatcacgcattctcacgctccttcgatttgcaattttgtccgcaagccatcccgaacaggccatcgcggcaatcaggcttatcaggatcacaaccaagatttccgggccgttatggacaagcaggtttctatacttcaccatgccgactgctgacgggataaaaaacaacagcagctccgccatcaggaaattggccccgatttcaatccagcccattttgacgatgccgaattgcagcaggagaaagagggcaatcattgccagcatgctgcccggcagcgggatgtgcaacagttttgcagctgcgcccatgacttcagcgaacagatacaaaccgacaatctgtaacattccgatcaggacttttttcaatattttcaccttctaaaactagtttaccgcgccggcgataataggtaaaatgaatatatagaatggtaaaaatgccttttatctatacaaggagggttccagttggatatccagcatctccagtactttgtttccgttgccactcacggcagcttcacgaaagccgcccgggaatgttatgtatcgcagccgacaatcagcaaaatgataaaaagctttgaagaagaactcggcgtccccttgtttaaccgcgccgggaaaaaaatcgtcctcaccgatgccggacaggccgtttttcagcaggcgcaaaaaacgctgaaagcttttcggcagctgacagatgcgatcaatgatgtggccggcctgaaaaaaggaaaaatccggatcgggctgccgccaatgatcgggtcgcgctattttccccgggtcattgatgaatttcatcatgcctacccggatattaaaatccagctcgtggaagatgttacaagaaaagtggtccgtgatgtggaaaatgggacattggatctcggcgccgtcgtgatgccggttgatgatgaggtgttcgggcatttttcgtttgtccatgaccggcttgtgctgcttgtgcacccgtcccaccggtttgcaggctgctcaagcgtccggctgaaacagctgaaagaggaggaattcatttttttccatagagattttgcccttcacgaccagattataaaggaatgtttgaagcttgggtttatgccgaacattatatacgaaagcacccagtgggacctcatctgtgaattggtagcgtccaatctcggcgttgccctgctgccaagtacaatatgccatgcgtttaacccggaacgcgtcaaaatcattcatctggaagaacctgtcctcccgtggaatctggcaatcatctggccgaaacaccaatacctttcttttgcggtaaaagagtggatccggtttacaaagcatttattcggccgcgggatcccgcctgccgtgccgcaaccggaagaagccatgaaaaaagaaagtgaaaaataggggcgcgggttcaaaaaaggggcgagttttgaggcactgcgaaatgcttctgaaatgcaggtaaaaggtgtctccataatagccgtagtgatgtttgagacaatgcgaatgcgtctgaaatccaaaaaaaccggcttgaggcagccggctaagctttaatgtcaatcctgtatatttcaaaccagtaatggatctgggcgaggtaggcaagcagctgcgggcccgtcatcagctgtccgaaccacggtgtccggaatgctttcccgtctgtctccatcaactccattaattgatcgcgatgcaaaaattcatacaaaatggaatctttctgttccaaaacttcaccgagccaccgcttcactgctgccgtgtaagccggatggtgcgtcttcggatacgggctttttttccggtataaaatctcttccggcaaaatgccttccagcgctttccgcaaaatgcccttttccctgccgccgtacatcttcatctcccacggtatattccagacgtactccacaatccggtgatcggcaaacggtacgcgcacctcgaggctcgcccccatgctcatccggtctttccggtcaaggagcgttgtcataaaccaaagcatattgatgtaaaacagctggcgacgctttttttccaaatcggtttcgccatctaaaagcggcgtttccgcaacagacgcttcatatttcgacatcacgtaatcttttaactgcaatttttcctgccagccttcttttaacaggccgatccgttcatcgagggaccgcatccatgggaagccttctcggttcaaatcatcttcgcgccggaaccacggatacccgccgaaaatttcatccgcgcactcacccgaaaggctgacggtaaaatcctttttgatctcgcggcaaaaccagagcagcgatgagtcaacatccgccattcccggcacatcccgggcgagaacagccgcttttaaagattcggccagttcttcctgcgtgatcacgcaatgatggtggactgtatcaaatgcttctgacatcttgcggataaataccccgtcagcatccggctgaaaatcattcgctttgaaatagcggtcgttcccttcgtaatcaatggaaaaagtatgcagccgcccttttccttccctttgaaaatggcctgcagcaatggcggtaatggcgcttgaatcgacgccgccggataaaaacgtgcaaaccgggacatccgagacaagctgacggacaatcgcatcctgaatgagcaaacggatcgtttccgccgtttcctctgctgcctccgtatgcggcgcgcttttcacgttccagtaccgccacacttttaatccgttacgatccatcttcagcgcatgtgccgggcgcagttccgccatgccgcgaaatattcccgtccccggtgttctcgacggcccgagcccccatatttcggcaagccctgcctcatccacttccgctttcacatccgggtgggcgagcatcgcttttacttccgagccgaacaaaagcccgcttccgtgtgctttgtaaaaaaacggttttaccccgaggcggtcgcgtgccgcaaatacctgttccttgttcccgtcccagaccacaaacgcaaaaatgccgttcaggcggtccacacatgcctctttccactcgatataagcggttaaaagcacttccgtatccgagtggccctgataagtatagccttttttcaaaagctccgcgcgcaaatcttccgtattgtacaattcgccgttatagcaaattgtatacatctttccgtccttttgccgcgtcatcggctgcacaccgcataaagggtcaacaacgacgagccgtttatggccgaatgccgcatgtggcgaaagccagtaattcgtatcatccggtccccgtttggtcaacgtctctgtcatttttttgactgtttccagttcactccgcaagtctttttgaaaatcgacccatccggttattccgcacattccggctcacccctcctgaatttctctacttcctgcagcccataaaagccgctttgccgtgccatttttcttaccggctgtattagtatataggcgtatgcccggaaatgtgcatggcccgtatgtgtaaaattttacgcgaaggcgtagcggggtggaaaaaacaggagaccatggtgtgaaacgaagtgaaaatgtcttttatggtaaaataaaactatataaaatggacaaaatattgccgctctattgcctgccgcaaaaaagtagttctcatgcaaatggatgcttgggcttgatgtaaaaacttaagttcattttatataagtttttttacagaaagggttgggccgatgatttctgctttgatcatcatcctggcgctcgtcttgttattgcctttttttgtgccgtttgtcgagcgcaatttggaaatatttttgtttatcatgggatgggctgcggccattgccggaggtgtcctggacaagcctctgttgagaaaggctttggaagatccggttaacatcaccattgccgtatttgtagccggcctgttgttccgctggctggagcggccgcttgaaaaagtgatttccgccattaaccgggggataccgtttccgcttctggctgccttgacggtaatccttctcgggttgctttcgagtgtcatcacggctattattgccgctttaattttagtcgtgattgtcagcgtgctgcggcttgaccggaaatcggaaacacagctcgtcgtctactcctgcttttccatcgggctcggcgccgcactgacgccgatcggcgaaccgctctccacccttgcgatcagcaagctgggggaggactttttctatttgctccgcctgatcgggccggaagtcatttccgcagttgtgattttcggcattctggctgccattgtgatcaaacccgaacagtcggcgatcgggctgaaaacggcgcatacacgagagtcttatgtggaaattgcgggacggacagtgaaaatttacttgtttgtgatggggctgaccttgctcggcgctgggtttgaaccgctcattaaccgcttcctgctcgatttgagcccgtttattttgtactggatcaatatgatttcagccgtgctggacaatgcgacactggcagcagcagaaatcagcccgaaaatggcggacaaaacggtacaggccattttgctcggactgctgatcagcggaggcatgcttgtacccggcaatatcccgaatataatctccgccggaaaactccgcatcacaagccgggaatgggcccggttcggcctcccaatcggtctcgccgccatggccgtttattttgtcgtgattttgtttgtataagagggttgaagacaggtttacaaaagtatagggatggctcccgctttgttctttttctgttatggaagacaaattgcgcggcgggctatcccttttttctttatctctgttgtgaaagacatttcgggagacggggattctctttttgtctttcatccccgttatgaaggacatttggggcgccggcgattctccttttgtccttcatccccgttataaggacatttggcttggcggagcttttccgtgtgtccttcattcccgtagtgaaagatattttccgcagcgggattcttctctgtgtccttcgcccctattgtgaaagacaggttgcatggcggtatcctcatcgccattgtgaaggacaatgctggttccctccacaaattctatacaaaatgaaagctccagtacagaagacatattactataataactccgaaaataagagcgccaatataaggaatcatttttaactttccaggctcttttctaataaaagaaacaatacttgctaagaagctaataccccaagcaaaccaaccccaatggtgaaaacgagtataatattttatatcttggcctgttaaaaatagggtaatagcaattataaaaagaataagcccaaggataaacataaaaaaggaaactttaacctgaattattcacataaattcagaaacttattataacttatggattaccaagtcttttcggctttattgtaattcattaaaaaaatgaaaaaagaatccatttctgttaaagttaaagtaaccaaaacaaaaaccaaacagaaaggattctttatatggttactttaacgcaaaaaacacttgatttcaatcaagaaaattcaacaactgatcaaaagtcaactacaacaatggattgcgggtctgccgaattatatcaaggtatacctacctgtttcagtctgcgaaagttgagttaacatttatagctggatacattatttgtgatgcaaatgcaactaagacaatcaaataagtaataataaacgttttagataaaaagaagcttttcaagccgtacacctccattcatcattcatgctatgcccagatcaagctttgagcaattttattatagcatcctttcgaaatcgcctccataaaatccaaggaaaattaatttttttccgaactgttaactgttttctcttttctatgtggttatcttcccgatcataggttacaatcttgatcagacacggctgcaataaaaccttttctgcctgtggtcagaaaaaaggtattgaaaagagaaaaaattcattctataatatgcgcatagtgttgtttagccaaccgttgtgattttccgggcatggggaccccttttatatccaaaattctggctactggtttcttcagttttatggttggaggatggttctctgtcggaatgtaatgtgaataggtgaatcatttgtcaaacccttcactgaatccgcttacaaaaatgacttcgaacaggggtatggcatggcagatggcgaaaaatcgatatgggtggcagtggggaggcgcccgtttcgcagagaagaatgaaagtcatccagtacatttttcaggatgaatgccatgccagggcgaacatggcaccgtcaaaagaacggaagcccatacccgccagcagcaaggcagtcggaatattgccattgagctgcttttggccgggaaatggggggaaggatgcacactgtttttacgcgcaaaaaagacgacagcgtgtaacttaatcaaggggatgggaggatgaatgcatttgcaaacaaaaacgttacaggaaacagatgaaaaatatttatggcatgccatgaggggagccgcaagtcccgggcagcccaatttgattatcacaaaagcggaaggtgcttgggtaacggacattgagggtaaccgctatttggacgggatggccgggttatggtgtgtgaataccggttacggccggaaagaattggcggaagcggcatacaagcagcttcttgagatgccgtactatccgttatcccaaagccacgtgcctgccattcagctggccgaaaaattaaacgaatggcttggcggggattacgtcattttcttctctaacagcggttcggaagccaatgagacggcttttaaaattgcccgccaataccaccggcaaagaggggacctggaccggtacaagtttatttcccgttatcgcgcgtatcacggcaatacgatgggggcgcttgcggcaacaggccaggcacaaagaaagtataagtatgaaccgcttggacagggatttcttcatgttgcacctcctgacacgtaccggcatccggatgacgtggaaacgcttgaaagtgccaaggaaatcgaccgtgtaatgacgtgggagctaagtgaaacgattgccggtgttattatggaaccgatcattactggcggagggattttactgccgcctgatggttatatggcgaaggtgaaagagatttgcgaaaagcacggtgcccttctgatttgtgatgaagtcatctgcggattcggacggaccggaaaggcatttggttttatgcactacggcgtgaagccggacatcattacaatggcaaaagggattacgagcggttatctcccgctatcagcgactgctgtcaaaagggaaatttacgaggcgtatgcgggcagtgaagattatgaccgtttccgccacgtcaacacattcggaggaaatcctgcagcctgtgcactggctttaaaaaatttggaattaatggaaaatgaagcgttgtttgaacgttcccgcatactgggtgaacggctgctagaagcgctaaaaagcctgaaggatcatccaaatgtaggggatgtccgcggaaaaggattgctggttggcattgagctggtggaaaataaacaaacaaaggaaccggctgcagtcgagaaactgaataaagtgataagcacctgcaaagaaaaaggcctgttaatcggcaagaacggtgatactgttgctggatttaacaatgtattgcagctttccccgccgttaagcataaccgatgatgactttcgcacgatcgtgcaagttttaaaagaaagcatcttccaattgtaaaaacgtttcttgttagaaaatgtgctgcaaaggagagagagggtttggagaatcagcaactaaagaaggacttgaaaattcgccatattacgatgatttcgatcggaggagtcattggcgccggcttgttcatgggaagcggcgccgtcatccattcggccggcccgggtgcagtcatttcgtatgctttggcaggtttacttgtcatttttgttatgagaatgctgggggaaatggcatcggtgaacccgacaagcggttcgttttccacctatgcgcgtgaagccattggcccttgggcaggatacacgattggctggctgtactggttcttttgggtcattgtcattgcgattgaagcaactgcgggggcagcgaatattcaatactggttcccggaaatgccatcgtggcttttaagtttaatattaaccgttttattaacgctcacaaatgtatattccgttaaatcgtacggtgaattcgaatattggttttcaatcattaaagtggccaccattgttttattcctgctgctcggcctctccgttattttcggcatcgttccgggtgtccaatccccaggactttccaacttaacagggaatggcggttttatgccgaatggctttggcagcgtcttattgggcattacggttgtcatcttttcttttatggggaccgaaattgtggcggtggcggcgggggaatcctccgaaccggaaagggcagtcagaacggctaccaacagtgtcatttggcggattctgatcttttatgtcggttcgattgcgattgtagccaccttgcttccgtggaactcggcgaatattttaaaaagcccgttcgtcgccgttcttgaacatgtcggcattccggcagcggctcagattatgaatttcattgtgctgaccgccgtactttcctgtttgaattctggtttatatacaaattcacggatgctgtacgggatggcaaaagccggcgatgccccgaaaatttttctgaagttaaataaaaacggggtaccggtttatgccgttttgtgcgggacggttttcgcttatgtcggggttatttttaattatatttccccggataaagtattcttgtttttagtaaacagttcaggcgggatcgctttattggtttaccttgtcattgccttttcccatttgcgcatgcgccggacggtggaaaaaacgaatccggatgccttgaaggtgaaaatgtggctgtatccgtatttaacttatgtcaccattttgggcattgttgcggttttagtcgcgatgatctttatcgactcattgcgcacgcaagtattgttgactttgcttattgccgttctcgtggtcggctcgtatttccttttgcatcctaaaaaaacaaatgtgctgccactggatagtgaggattcaagtataaaatcttaagcacagcaaaaagcaccgtctcttttaaaaaggcggtgcccattttccagctgttaatctgaagccggttttgtttgcatggttttctttctgttttcctttttggcgcctggtttaaatgtatctgcccgtttcacaaaaagggacatgatcaatacgacaatattaatcgcgagcgcgacgtagaaggaatattggatgccggccagcaacgctttttgtcctaaggcggctttatcagctgctgtaaagtgaagcggattgatcccggacatcaggtcttccgctttcgattttgtgacagcattcatgatcgtgacaaaaacggctgttccgattgacccggaaacttgctgtgctgtattattaaccgccgttccgtgcgggttcagccgggaaggcaattgattcaagccgttcgtcataatcggcatcatcaccatcgacatcccgaacatccggagcgtgtaaaccagaataatataggtgtagctcgagtcaatttgcaaattcgccaacatataggtggaaacagctgtgatggaaagccccgtgacagccagcacgcgggggccgaattgatcaaacagctttccggtgatcggcgacataatccccatgacaattgcgcccggcagcatcattaagccggagtcaagcggagagatgccccgtacgttttgcacataggcaggtgttaaaatcatgccggaaaacatggctgccgcatttacaatggcaatgacagaggcaagggcaaacatcggatatttatacacgcgcaaatccaataaaggttcatccatcataaactgccgaataacgaaggcgattaaagccaaactgccggcaatcagtgccgttaaaaccactggatctgtccagccgtccgaacttgcagaactgaatccgtaaagtaaaccgccaaacccgatggaagacaagactaccgaaagataatcaagcgttgcttttttattttgctccatgacgttttccgctttccagatccccagaacgagactgatgacggctagtggcaaaatcatttcaaacagaaagcgccagtcaaagtattcgacaatgtagccggataacgtcgggccgattgccggggctgtaatcatgacaaggccaaagacccccatggctgttccacgtttttcaatcgggaaactaaccagcataatattcatgagcaatggccccatgacagaagatcctgcagcctggatcatccttcctgtcagcagcagcccgaagttcggggcaaatgctgccagagcagtccctaacgtgaagattaacatggccgtaataaacaactgccggtttgtaaagcgggtcagcaggaaggcggatgcaggaaccagcacgccgctgaccagcatataacctgttgcgagccactgaatggtggaataatctttgatgtgtaaatctgccatgatggaaggcagcgctacattgagcagcgagttattaagaaatgaaacaaaggcgccgataaaaagaaccccgatcatgagatagggcggccttttatgatgtgttgctggattcatatactctttttcccctttttgtaaattgtttttatttcttgcctgaaattgccggagaaggttccctgtacaatccttttttgagcagttccatttgggcaagataatgatcgagtgcttcttcggccgttaattcccttgcgaatgcttgcacaagattatgaaaggtgacggcctccaaaatcgtgatcatatcctgcagttcccgttcattattgatgttcaatttttttgtgttgacggaccggagcaaagccaaatcctgctttttcagatcctcttcaaaaaaattttctgccaaagtattttcggttttataattcatattggaaaaagcatttttgaaaaaattggcattttcctggtttcggatgtcttgaatggcaaattgaaagacctcggtaaaagccgcaaataaatccccgccctttttttggagagtggaaataaactgttctttgctttttcgtgagagcaaacgcagcaaataataaaacaaatcctccttgtcttcaaagtattggtaaaagctgcctcttggaatgcaagcctcctttacaatgtttgcgacagaggattcgtgcagcggcgctcttgaaaattccttttttgcagcttgaatcaaagtatcctgtttttctttcggcaaccggaaaaaagttggcttcggcatggcagcatattctcctatcttgaaaaattgcggcacgggcatctgtcctgaaaatgacaccgtgtcataaaagaaacaataagaagattatatatgacaccgtgttaagatgtcaatgaaaaaatgacaccgtgtcactggaaacatttcttaataaagtgcaccggtctcttcgccgcagcttgccgggacaaaataaggacaaccgtatctgaaaacacaaaacaggctggggaagttttaaatccggtcttaccggtcgcgaatctgcggggaaatcgtcgcaggtccaattatggaaacacaggctggtgcccgtcccagtttttactatataaagtgaacggaaaaaggctattctgttgcctgcaaaaataatcgtcctgaagtataacgaaatattgcctgctgtaagctatcatacaatgaatggtttggcgctcatcagaatttttccttcattaaaaataaaatttcaaaggccgaaatggaaaaaatcggtgattgtttagacaaaattagagaaagcaaatccgaactcggcatttccaatgtgattgacccgatccatacgccggaagccaaaagttcccttttatcaaaagacggcaccacgcttatggtcagcttcaagctggataaaaaagggagagaaatcgatgacatccaaaaacagtttgatgccaggctgaaacattcgcctgtcgattattatttgagcggggaagattttattaacaatgactatttgaaggcctcccaagccggtgtggagcggagcgcagcattaacggtcatttttattctcgttgtgctggtgattgtgttccgctccgttgtgaccccgctcgtctcgttggcggctgtcgctttttcctatttgtgttcaatggggattgccgcccagcttatcgacaaagccggatttccggtgacaagcttgacgcagatgctgcttgtgctgattttatttggaattggaaccgattataatatcctgctttttaaccggttcagggaagagttgtcccacgggaacccgattgatgaagcgattgtccgcacataccggacggcgggaaaaacgatcgcctatagtattgtgaccgtttttatcgcatttctggcgcttatattttccgaatcgccgatatatcggtcaggtgtcgttgtggtgatcggggtaacgatccttttgcttgaaattttaaccctaactcctttcatcatgaaagtccttggtacaaagctgttctggccgtcgaaaaatgcaagcgggcataagccgaaccggtactggggaaaagcttctttcatcgccgtaaaacatccgattattacagtcacactcattcttttgatcattgccccggcattgatcttccaccaggagaagctgaattttgatacggttggagaacttggcaataaatatccttcttccaaagcgatcaaccttgttgctgaacatttcgggaaagggcagtccatgcctgcggaggttgtgattgagaacggaaaagcaatggataataacgcatccatggctgtcattgacaatattacacaaaggctgaaaaaaatagacggtgtcgggaaagtttcttcggttacgcggcctgaaggaaagaaaatggaggacttttacatcgacaagcagatgattacggtaacggacggcttgtcgcaaacgcaggacggggttgaccaaatcaatgctggattaaagacagcccaggagaaactcggatccgccgatttttcgaaagtgaacgacatggtagatggaaccgccaaacttaaaaatggaatggccgctctcaccaccgggctcgaaaaaattcaaaacggcattggcaatgggtccgaccagccggaaacactggcaaacggcatcgctaccattgaaaaaaatctttcccaaatgagcagcggggtcagcacattgtcagcaaattacgggaaaatgcaggccggctatgctgaaatgggcaaaaattatcagcaggctgcacaagcactgctcggtgtaaaaagtgcgattgcgcaaatgcagacgctcgtgacggcgctcgggcaaagtacgccaagtgtgcagagcgaccggaactatttggcgctgaagcaaatgacaaaccagctctcatcatccctcaagcaaatcacgccggaagggatcaacacgctgaacagcaattacgacaagacgacagccgggttcaagacagcgaacgacaatctatccaagatggctggcgggctttcgcaaatggcagacgggctcaagaaaaccgaaagcgggattggccaggcgtctgatggcatcggcaaaatagtaaccaatatgaacgatgtgacaaaggggctgggccagatgaaatcgggccagcagcaactcgcttccggccttagcggttttaaacagttcggcgataagttgtcggatgttaaccgcggattaaagcaaatttcagacggccttggcaaaacaaatgactatctggcacagctgaaaacggaaaaaacattccatattccgaaagaagcgctcgccgacaaagattttaaaaaagcaatggacacgtatatgtcggatgacagaaaagtgacgaaactgactgtcgtgttgagcaacgatccttattcaaatcaatcattggataccattgataagatcaataaaacggttgtcaccgggctgaaaggaactgtgctttcaaaagccgacagcgggacagccggaacgagtgcaacgaccaacgacatgaaccatattctgtcaagggaccttgccaaatcaaccgtgatcgtgaccatcagcgtgctgcttgtgcttctgttggttatacggtctttctggccgccggttttcattacggcatcccttgtcggtgcctattatacagccatgtttgtcatcaactctatttttcttggcatgctgggctatgaaggcatttcttcgtttgtgccgttcttttcctttatcatcatcgtctcgcttggtgtagattacagcattttcctgatgatgcgctataaggaatacccgcagcttgacccgagggaagcgattatactcgcttcgagacatacaggcggtgtcattatttccgcggtcgttattttaggcggcacatttgccacgctgatgccttcaggaatgctgctgctggctgaattggcaatcgccgtcattaccggccttgtcgtgctttgctttatcctattgccattctttctgccaggcatgatcgccttgccggaagccttggaaaaaatattttcggacaaaaagaaagaaaacttggagctggagaaagaatcatccaagcgataatgaaaaaagcagccgcttatccaaattgggaaagggctgctttttttgctggcacggttttagatcgaggcggaggaagcaggtaaccttttagctaaagtacggtaaagagatggtaagtgagcaaacaggccaactatttttttgaaaagtgagcataaaacgagtataggtgaaggagcgggcgcaaaaactggtgtttcttaacgtagaacgggtctaagtgaaggaagcgcgggaaaaaattattgtttcttaacgtaggacgcgcctatgtgaaggaagcgggcgaaaattccgttgttccttaacgtagagcgcgcctacgttaaggaagcgagcaaaaaacgcagtgttccttaacatagagtgcgtctatgttaaggaagcgggcgcaaaagacgttgttccttaacgtagaacgggtctaagtgaaggaagcgcggaaaaaacgccgtgtttcttaacgtagaacgggtctacgttaaggaagcgggcgaaaattccgttgttccttaacgtagaacgggtctgagtgaaggaagcgcggaaaaaacgcgttgtttcttaacgtaggatgcgtctaagtgaaggaagcgagcgaaaaatctggtgtaccttaacgtagaaggggtctacgttaaggaagcgggcgaaattccgacaaacaatgtacgtaaacgcccatatcacaaaaaatacatgccagcggaagaatgaaaatcccgtcgcaaatcaggatagaccgcttcgaagtgcctaaccccgtgaaagatgccattttagcatgtatcaatttccggggttcctctatactaaacgtaaaagcattttagaaagaaggggcaagcatgaactattttgcgggtttgctgattgtctgtgcgctcgtgctcggcaatgcggggtgctccgcaaaagatggcaaacaaagccgggaagctgcagcaatcaatacggttgcgcattctggctgcacggcaaagcaaaaagcggaacagaccaaaatgggggttgcctggtaccggacatccggggaagcaaaagcgctctattatcaaggatacaatatcggaaaacagcgtattgaggagagcctgaaaaccaaggtaaaaaagaagcgggccatcgtgctggatctcgatgaaacggtgctggataacgggccgtacttatcttatatggtagaaaaaggcatttcgtttggcagcggctggggagcatgggtgaaaaaagcaaaagcaaaaccgctcccgggggcgctttcctttttaaaatatgccgacaaaaaaggaatcgatatttattacatttcaaaccgggacgaaaaatatatggatgccacccttcgcaacttgaaaaaagaagggatcccgcaggccgtccgttcccatgtgctgttgcaaataggaacaagcagcaaagaagcacgccgacaaaccgttgaaaagaattatgaaatcattgccttgttcggtgataatctgggtgacttttttaagacatttgacggaaaaggaaacaaggcgcgcagcctggaagcagaccgtttccgccatgcatttggccgcaaatttatcgtattcccgaatccggtttacggggattgggagcatgaattgccatgtggttcataaacgcaaaaaaattccggagttctccggaatttttatatgcactatgtatggcggagaaggtgggatttgaacccacgcgacggtcacccgccctaacgcatttcgagtgcgtccccttcagccgcttgggtacttctccatatggaaaaaagaaagatgctggtgagaggactcgaacctccgaccccttcattacgagtgaagtgcactaccaactgtgctacaccagcatggaatcaatcaggacaatgtaaattatattataataaaatccggattgcaagaggaaatttaaaaaaagtgttgtaatgtttttccggcatgtttccggtaaaataagagaaaagatgtttccgggggaggaaaggatatggattttttaaaagcctcaacgctggaggaaaaactggacctaattcaaacgcttgccggcccgttttccgaaagggcggctgccaatgacttggaaggacggtttgcttttgaaaatattcaagatttaaaagaaacaggctatacaaagctgactgtgccgcaaaactacggtgggggcggcatttcgctgtatgagcttgtccgcctgcaagaggccatcgcggttgcggacgggtcgactgccctttccatcgggtggcatatggggattttaatgcatttgtccgaaacaagaacatggaacgggcaattgtttgaacgcatttgccgtgcggcagcagggaaggccgccctcatcaacacttgcgcaaccgaagcgcaaacgggcagcccgacgcgcggtggcatgccggaaacaacggcaacggaaaagaacggcgaatgggtgttaaacgggagaaaaacatttgccaccatgtctccggtgctcgacttttttatcattaccgcaacgattccgaaaaaagaagcggttggcagttttgtcgttccgcgggagacggctggcctttccgtcgtcgaaacatgggacagcattgctttaagggcaaccggcagccatgatgttgtgctggaaaacgtcaaagtcccgcttgcgaacctggcggagatccagacgaaaaagaaagagccggccggttatctgctccatatccctgcctgttatttaggcattgccgaggcagcgaaacgggaagcggcccgctttgctaaatcgtatacgccgaacagcctgaaccatccgcttgcggaactgccggctatccgccagaaattcggtgaaatcgagctgaaattgatgcaggcgcggcattttctgtattcggttgcgaaaatgtgggatgaagccggagcagaacaaagaaaagagatgggcccggaacttggggcagcgaaaatggcggttacgaatcatgcgatagaagcagttgatttagcgatgcgaatcgtaggtgccagaagcctgtccgaaaaaagtccgctgcagcgctattaccgcgatgtccgcgccgggctccacaacccgccgatggatgatgccgtccttatgcagctcggcgcgcgtgtgtaaaatcaaaaagcatccgatggtctaaaaagcgggaaaacagaattgtggatctggccatgaggatagtcggcgcccgcagcctttttcaaaaaagcccgctgcagtgctattaccgtgatgtgcatgcgggattacacaatccgccgatggatgataccgtccttatgcagctcggcgcacgcgtgtaaaatcaaaaagcacccgatggtctaagcagccgggaaaaagggggggcgcaaagcagcagagcgccgccgcttttttcggtccgctttgtcgctactgctaaaaaagcggcaactgctgataaatgcactgttgccgctccatggtttgcttacgttcgatgatgtgccggatgagcccgtacgatttcatcctgccatttttcaaggattttcctgatattttccggggcggttttcggcttgcgggtgtaagacagcaggccgtttgtttcttgctcgacatctgcaagctgcgtataacagaagcctcctccttatcaaaacgtattataataaaaaataaaaatttagaaataatttattgtcgaggtattttttatgaggaaaatctatgaattcatgagtaaagatgagaagaagaaggctatatctttgcttactaaagatatagatgagctaaagaaggaacaaaaactagaagatgaaaagggatatccccgagtagtaaaagacgcaatagaagaaacaatccaaaggtacaaaaaagatatggagtatttaaaagatgatttaaaaaaagaagagaaaaaatcttaaatcagttattacagcagtggatcgtattggaatggtaaatgattgtactgaggctctattatttatggcttgctgaataagcaaaattcctagatttggcaaggatgctgacagctttggcaacaatttaaatgcaagggttttacaacaaatccaggaaaagttgcacgcgaaagccgattcaacgtattgagaagacaaaatcatgcattttcgcatatattttgtgacggagtttgcagaaaaatttggtacaaactcagaatcggattcgttcagcaagccctatttagaaatggaatattaccagtaaaaattttagtaaaaatgttgcctttttttacttctgcgtgtaagatggaattgaagaaaacgtttgcaatctttttattctattctattacacttaggggggaacgaccatgagcaacccaaatttgtctcaggcttttaaggagtatttcgggacggcggcggagcgcgcgttttttgcgccgggccggattaatctgatcggggagcataccgactataacggcggccatgtgtttccgtgcgcgattaccatggggacgtatgctttggccaaaaaacgcgatgaccgcaacattcgctttgtatctttgaattttaaagaaaaaggcgtcatcgaatttacgcttgacgatctggcatacaacaaagcacatgactgggccaattacccgaaaggcatgctgaaatatttgaaggaagcggggcatgaaatagaacagggttttgactgcctcgtgtacggcaatattccgaatggggccggcctgtcttcttccgcctccattgaactattaaccggcgtgatgcttgaaaaattgttcaacctgaaagtggaacggctcgatcttgtcaagctcgggcaaaaaacggaaaaccaatttatcggcgtaaacagcgggatcatggatcagttcgcggtcgggatgggcaaaaaagacgcgggcattttgctcgactgtgccacgcttgcgtacgaatatgccccgatcaagctggatcaccataaaattttgattatgaacacgaataaacgccgtgaacttgcggactctaaatataatgaacgacgtgcggaatgtgaatcggcactgaaacagctgcaaaagaaactcgatatcgaaacgctcggcgatttgacagaagaagcatttgaaaaaaacaaggaaatcatagacaatgagattgtgaggaaacgggcaaaacatgcggtttacgaaaatgtgcgcacgctaaaagcacttgacgcattaaaacgtggcgacctgcccgctttcggagaactgatcaatgcctcccaccgttcgctgcgggatgattatgaagtgaccggcaaagaactcgatacgctggccgaaaccgcctggaagcaggagggcgtgctcggggcgagaatgacgggcgcgggattcggcgggtgcgcaatcgcaattgttgaaaatgacaaagtcgatgcgttcatcaaaaatgtcggggacgtctatgaaaaagaaatcggctaccgggcggacttctacaccgcaagcatcggtgatggagcaaaagaaatgacaatggaggaacttgtatgagcattttagtattaggtggagccggttatatcggctcgcatgccgtatatcaactgatcgaccaaaaatatgacgtggtggtgattgacaatctgcaaaccggccaccgcgccgcaatccatccaaaggcaaaattttacgaaggcgatattcgcgaccgtgcctttatgcaggaagttttcgggaaagaaaaaattgacgcgatcattcattttgcagccaactcgcttgtcggcgaatcgatggaacagccgctgaaatatttcgacaacaacgtatacggtacgcaaattgtgcttgaaatgatgaaagaattccatgtaccgcatattgtgttttcttcgactgccgcaacatacggggaaccggaacgcgtgccgattacagagacaatgccgaccgttccgaccaacacttacggcgagacaaaactgacgatggaaaaaatgatgaaatggtgtgaaaaagcgtacggcatcaaatacgttgcacttcgctattttaacgtagccggcgcaagatcaaccggcgaaatcggcgaagaccaccatccggaaacgcatctcatcccggttgtattggaaacggtgctcggaaaacgcgaggcaatcaccattttcggcgaagactatgatacaaaagatgggacatgcgtccgcgattacattcatgtggaagacttgattgatgcccacattctcgcgcttcaatatttgcaaaacggcggtgcaagcgatgtgttcaacctcggatcaagcaacggattttctgtcaaagaaattgtggataccgtccgggaagtgaccggcaaaggctttaacgtcaaaatcggcgaccgccgcgccggggatccgagcacgctcatcgcttcatccgaaaaggctaaacgtgtgctcggctggaatccgcaaaaaacggatatccgccagattatcaaagatgcatggaactggcatgaaagccatccaaacggttacgacgacagaaggtgaaaccagtggcaatttttgaaacggtcgagcagcttgtaaacaaggctgtccgtgccgggttaatcggggaagaagaccgggtgtatgcgagaaaccaggtgctgtcacttttgcatctggatgaatttcatgaaccggaagaaggcggggcggatcaggatattcctgatctcctccgcatccttgtccgttacgcgtgcgaaaaaggcatcattcaggatgtattggatgagaaagacatttttgcaagccacatcatgaatgtgtttacgccgcgcccgtcaacggtaaaccatattttccgggaaaaatatgcggaaagcccggctgaagcgaccgattatttttacgcattaagcaaacacagcaattatatccaaacgaagcagattgcgaaaaacattgtatacaagacgccaacggaatacggcgatcttgacattaccatcaatctttcaaaaccggaaaaagacccgaagtcaattgccagggaaaaaaacgccaaaaaaggccattacccgaaatgcctgctttgtatggaaaacgagggatatgccggcagaacggggcatccggcacggtcgaaccaccggcttatccgccttaccctcggcggcgagccgtggtatttgcaatattcaccgtatgtatattacaacgaacattgcatcgtgctgtcggaaacgcaccgtgatatgaaaatcgacaaagcggcttttcaaagattgcttgaatttgtcgggaggttcccgcattatttccttggttcaaatgccgatctgccgattgtcggcggttcgattttgtcgcacgaccattatcagggcgggcgttatgaatttgcgatggcaaaagcggctgacgactggcagtttgaaatgaaggcatttccggatgtggaagccgccgttatcaaatggccaatgtcggtcatccggctgcgaagtgcagaggcggcacggcttacagaggccgcggatcatattttgcaaatctggaaacagtacagcgatccttccgccgacattctcgcggaaacaaacgggacgccgcataacacgattacgccgatcgcaagaaaacgcgcgggccggtttgaacttgatcttgtgctccgcaacaaccggacaagcgaaacccatccgcttggcattttccacccgcacgccgaggtccatcatattaaaaaagaaaatatcgggctgattgaagtgatggggcttgcggttctgccggcacggctgaaaaatgagctggccgaagtggagaaatatttgctcgggcagccgaacgccattgccgcctaccatcttgactgggcaaacggtttaaagaaaaaatacgaaggcacggtggcagcggaaaacgtggaaggcatcgtccgcaacgaagtgggcaaagtcttcttgcaagttttgcagcacgccggcgtctttaaacgggacgaaagaggaaaacaggcattccggaattttttgcgtaagttgtaggcggtccgttccaacctttttttgcgcatgttcacggtgaaagggtgcgggctgctaaacgccttccggaatgtaccgcgcacaccaaacagcaggccggttttttacgtggctttcaggccggctgcggattccggaagcgattggcgcggccgcggggaacaggagccggcaacgcgttccaacatttttagcatacgcttttgacgcatatagggggctgcagatcacattccgtaacttttagctcagacgggtacaccgggccgttttatatggcccgcaatctttaacggaaaagggctgatcaaaatggaaataaaaaaggcattgtttggggaattggaagggcgtccggtccatgcttatgaattgaaaaatgaccgcggcatatctgtaacggtgcttgaatacggttgcatcatcaataagatcatcgtgccggacaaaaacggcaaagcggaaaatatcgtgctcgggtatgacaaccttgacggctacctccatggtgttccgtatttcggcgctatcatcggccgtattgccggcaggatcgccggagcttcttttgaactggacggcaaaacatacaagctttctgccaatgaaaaccgcaaccatctccatggcggcttcaaagggtttaacgccgtcatctgggacagcacacccattgaacaagacggcgcagttggtgtgaaatttacgcatataagcccggacggcgaagaaggctatcccggaaatctcgatgccaccgtgacctatcttttaacaaatgaacaagaactgaagctgtcttatcaggcacatacggataaaaaaacgatcgtcaacatgaccaatcatgcatacttcaatttaagcggcgatatgaaacgcgatgtacgcgggcacaaattgcaaatcccgagtaaccgtgtgcttgaacttggccaggaaacgctgccgacagggaaaactttcgatgtcaccggcaccgcgttcgattttcggaacgggcgaaaaatcgaagacggcacggtatcagatcatccgcaaaacgtccttgtcggaaacggctatgaccacgcgtttttattgccggaaacggaaaaaacgatccgcttaaaagacgaagagagcgggcgcgtgctgacggtggaaaccgaccagccttgcgtcgtcgtttatacttgcaatacaatgggcaatgacgaatatgaaatccgcggccgcaagccttcagattatttggcggtctgccttgagacgcagggtgtgccggatgcgatccatcaccctgaatacccgtctgtgattctagagccgggtgaaacataccgtgcccatacaaaatggatttttggttgaaaaagattgaggtgtaagcatggcaacgattaaagatattgcagagaaggcgggtgtttccatttcaacggtttcacgcgtgctgaataacgacccgtcactttccgttagtgacgatacgaaaaaaagaatctttgaagcggctgaagcgctttcctacaagaaaaaaacagcccggaaaccggaaaaaattaaaattgcgctagtgtactggtatacggaacaagaagagctgaatgatttgtattatttatcgatcagaatgggcattgaagcacgctgcagcatgaaaaatatccggctgacgaaatacgatttgacgcatttggaagagatggggaaagagcaaatccagggcattattgctgtcgggaaattcagcctggcgcaagtggagaagcttctctctgttaccccgaatatcgtatttgtcgactgctcgcctgacgacaaccgctttgatgctgttgtggccgattttgaaaaagcgacagaaaaagtgctcgcctattttacggaaaaaggccatacacaaatcggctttatcggcggcagggaaaattataaagatgcgtccgccacgattgaggatccgcgcgaaacggcgttcaggcgctggatgcaggcagcaggccgctggaatgaaaaatgggtatatatcggtgcgttttcgactgaagacggataccagttgatgaacgaggcgatccgcgaacacggggacgcgcttccgaccgctttttttgccgccaatgatgcgattgcgatcgggtgccttaaggcgcttgcggaaaacaacatcccggtgcccggccgcgtgagccttatcggcgtcaatgacatctcgctgtccaaatatgttttcccgccgctttctactgtgaaagtgtatacggaattgatgggcgagacagcagtcgatacgctgctggaacgtttggaaggcagaaccgttgcaaagaaaatttttattgccacaaaacttgtttgccgcaaaagcggatgagtgagtgggaaagcgggtaaaaatgattttgaggctgtctgttgcgatcttggttttggaatggtatggccgcgaactttacggaaagcggagtaaattttagggcagatgatgcaaaggtgccgaagcagtgcaggtcccggtttcaataatagcgggggcacgaaagaaaatgggcgggctttgcgaaaagtagagtagcgattaaggcaggctttgcaaatgcatcggggcagtgcgagtataggttgctgtttcgaaatggcatatattgcaaacaaaaccgccgcaaacctgtcgtaagtgggcaggattttagggcagatgatgcaatgccttgaagcattgcaagtacctgcttcaaaaatagcagtggcgcgaaagaatggccgcggctttgcgaaaagtagagtagcgattaaggcaggttttgcaaatgtatcgagcagtgtggatcccggctccagcccggttccaggctgcagcacttgcctcgtgcaaagcggaggcccgcataaagccggggccgcatgcatataatagaagcatgcacgaatgcgccgggacggtttgcacacttgcctgcatacgttaacgcagcagggccggtccccttttttgtgttaaagtgtgttatactaaacataagaagggagtcttttatgatggcatattttaataaccagaaggagccggtgcctgaggtggaaacgaccgtatgggcctgcacaaacgatgattgcaacggttttatgcgtgaaaactttacttttgaagaaaagccgcactgcccgctctgccactccgatatgaaaaaagaagtacgcgtgctgccagttatcggaagttaaaaaaacagttattttttgttgccatttttcgggcctgttgaaacccctgttttcaacgggttttttactatctgcgggaatcgttaagccattttttgtaaaacccgattgcgcgcggtctccagcatacaaaaggggtgccatgaaagcacccctttatctcactttttttctttccattcggcgaatatctcatccgcgatttcttccagagatttcactttgccgtgcgggttttgcgattctttccggactttccactgtcgttcttcttcgcgctttgatttactcacttggatcactcctgtttgccatctgtaaatttcgcgaatcttttcatatccttatccgtttcaagcgctgtcacagcaaacggtttataaggcttatgttcactgaacaagccaacctggttgctcccatgcgcatcattgacaaccgtttccgcctcattgtcccgatgcgtcacctcacgtttgtcaggcatagtatttccactccttgttcaaaataaaatcatgttttccgccgatcaatgttataattacctattatgaagcaaacgatttacggaggaggaaactgctgcaatggatttaacaccaggaaccgttgccgaacttacggtggtgcgggaagcgccgttcggttattttttatctaacgggacagaagacgtgctcctgcatcaccgggatattgtggaaccctttgatccggaagcggtgcaaacggtctttctatatcaggaccatcaggggaggctggccgcgacaaatgtgattccggacatccgattggggacatacggctgggcggaagttgccggcaccaaagaaaaacttggcgttttcgtttcgatcggaattcacaaagacatgcttctttctgttgatgacttgcccccgatccgctcgctctggccggaaaaaggcgatcgtttatacattacccttgatcttgacaaacatgggcgcttattcgcaaaattagccgaagaaaacatggtcagggatttagcgaaacaagccggtcgtgaaatgtggaacaaagatgtcaccgggcatgtgttccgactgacaaaagcgggttcttcaatcataaccgatgagggctttattggcttcatccatgaatcacagcgcaaaaacgaaccgcgcctcgggcagaaagtggaaggccgcgtcattgatgtaaaagaagacgggacactgaatgtctcgcttttggggcgcgcttatgaagcattggataaagatgcggaaaatatccttgcctatatggattcccgcggcggaaaaatgccgtattgggataaaagcatgccggaagagattcaggagcggtttggcatcagcaaagcggcgtttaaacgtgcgctcggccgtctgatgaaaaacggcaccgtctatcaagaagaaggctggacttatcggaaggagggaaagtaatggcagctccaaggttgaaacgcattcaccatattgccatcatttgttccgattatgcaaaatcaaagcatttttatgtcgattgcctcggattggagccggtgcgggaagtatatcggaaagagcgggattcctacaaactggatctttcggtcggcggcgtatatcagatcgagctgttttcctttccgaatccgcccgcgcgtccgtcatttccggaagctgcgggcttgcggcatcttgcatttgaaacggacgatgtagaagcggataaaaagcggcttgaagaaatgggcattcaagtagaagacatccgcattgacccgcttacagataaaaaattcacctttttccaggatcccgacggtcttccgatcgaattgtatgaaagctgacctgttactgcggatgaaaaaatttgcagacaaacggccggtgcaaaaaaacagattggcagataaagaaatagaaaacgcccccgtataaacactaaaatttggcaaacaaaaaagcggcatccggacagcaaaaaaatggcaggcaagaaacgaaaaatggttccaaatgggcaaaaaatttttcgctcagaagatagctgaagacaaacggccgattgaaaaacacggggataccgggacagcaaaaaatggcaggcaagaaacgaaaaatggttccaaatgggcaaaaaattttgcatgcagaagatagctgaagacaaacggccgattgaaaaacacggggataccgggacagcaaaaaatggcaggcaagaaacgaaaaatggtcccaaatgggcaaaaaattttgcgtgcagaagatagctgaagacaaacggccggtgcaaaaacacggggataccgggacagcaaaaaatggcaggcaagaaatgaaaaacgtccccaaacgggcaaaaaaattttgcgtgcggaaagcaaatggccggtgcaaaaacacgggataaccggcgcgggtgcaggagcggtatgctataatgaaaaggactgaaaatgctttgttcatatttgagcaaaggattgcctttcaaggaggaagatttgaatgagcgagcctttatttcttgaaccggtttttaaagaaagaatttggggaggaaccgcgctgagggaccggtttggttaccgcatcccgtctgaccatacaggggagtgctgggctatttccggccatccgaacggcccgtcgactgtaaaaaacggtgaatttgccggcaaaaccttgatggaactgtgggaagaaagacgtgacttgttcggcggaatgtctggaaaaggattcccgctcctgacgaaaattctcgatgcaaatgcagatttatcggttcaggttcacccggatgatgcatacgccaatgaacacgaaaacggagaacttggcaaaacggaatgctggtacatcattgattgcaaggaagacgcacagctcgtttacgggcatcatgccaaaacgaaagaagaattcgtccgcctggttgaagaaggaaaatgggacagcctgctgcgcaaagtgccgattcacccgggggactttttctatgtgccgagcgggacgattcatgctctttgtgaagggacgcttgtgctcgaaacgcagcaaagcagtgatacaacgtaccgcgtttatgactacgaccggacggatgctgccggcaacaaacgtgaactgcatttgcaaaaagccattgatgttacaacgataccgcaccgggatgccgcagtcctcccccgtacggaagaaaaaccgggtgttaccatcacaacgtttgcaaaggaagcctttttctctgtatataaatgggatgtaaaaggaaccgcatcgtttacccaaaacaaaccgttcgaactggccagcgtgcttgacggggaaggggccatgaaagccgacggaaaaacttatccgcttgaaaaagggatgcattttctgctgccgtccggatttggccattttgaactggaaggtcatctgacgctgatcatatcccatccgtaaactgtctgtctatcaagaatattgcagcaaacggcagaaaaccgatataatgaaaaatacatgacaactgagtatgggggagacgttgaaaatgccaatcaatataccgaaagatttacctgccggagagctgctgagacaagagaaaatttttgtgatggatgaggacagggcgagaacgcaggatatccgtccgctgaatatattaatcttaaatttaatgccggaaaaagaaaagacggagttgcagctgctgcgccttcttggcaatacgccgttgcaggtcaacatcacttttctccggacgtcgacttaccaatccaaaaacgtcagcagctaccatttagaacatttttacacggtttttgacgaggtgaaaagccgccgttttgacgggatgattattaccggtgccccggttgaaaaaatggatttcgaagcggtggattattgggacgagctgaagcaaatcatggattggaccaaaaccaatgtcacgtcgacattacatatttgctggggcgcgcaggctgcattgtactaccattacggcattgagaagtacgaactgccggaaaagtgtttcggcattttcaaacaccgcttgtttttgccgatggtcaagctggtccgcggatttgatgaggtttttaacgcgccccattcccgctatacggatgttgcacgcggagccattgaaaaccattcggaactgcagctcgtttccatatcggaagagggtgcgccattcattgtgatggacgaaaacgggaaaaatattatgatcaccggccatttggaatatgacgctacaacccttgctgatgaatatgtgcgcgatcagcaaaggggccttggtaccgccctcccgaaaaattattttccgaataacgatgccaatgagaggccgctccatacatggcgctcgcacagctacttacttttttccaattggctgaactattatgtataccaagaaacaccataccaatggtaaacaaagagctgtcccacaaacaggggcggcttttttggtgcttggggatttcaaaagaaagttaccgttcgattcagctggcttttgttcctttgaagcttgctaaaggacaatgcgtaaacggcaaaaagcccccaactgctatcagaagcatcccaaaaaaagaggcagccccgcgtatcaggacagccccttttcgctttccgctttcggaaccgcgaaagagagaagaaaacaaacaagtgaaattatggcaagcaggatgaagatcgaatgaatgcctgaaaaaagcacatgccgcagccaatcgcgcgccgcttccgaaaaccggcctgcactttccggattgatcagcctgttcagcgaattcgtcgtaaacccgcccggattgtctttcgcaagttcctcggcaacttttgcattgaaatacgtaccgaatacagcggaaccggccgactgcccgagattccggaaaaatgtattcgatgccgtcgccgccccgcgcaaagaccagtccaccgccgactgaaccgaaacgagcgagatcgtcatcacaatcccgaacccgaacccggaaatggcggagaaaacgtaaaaactccattcctgcgttcccaatgaaaacaagctgagccaggcagtgcttcccaagatgaaggccatccccgttaaaaacgccaaacggtccccgtatttcaactgaagccttccgccggcaaaagagccgagcatccacaagacgggactcggtgccagcataaggccggaaagcgttgcgccatgcccttcaagcccttggatccacatcggaatatatacgttaatccccatcagaacggcactacccaaaaaacaaaccagatttgaaaccgaaatggcccggacgtggaacaacgaaagcggcattaatggatccggatgccggtactcaatcaaaatgaataaaccaaggagaataacactgccagctaacaatcccaaaatcaccgggtttccccagtcgcttgtatccccgcctttttgcagggcgtaaagcaacgcgagcatcccggcggaaaaggtggcagccccccatacatcaatcgcattttccgttttttccaccggctcatgtaaaaacaggatgaccatcaaaacggaaatcagaccaaacggcagattgatgaaaaagatccagtgccaggtgagctggtcgacaaagaaaccgccgaaaagaggcccgatgacaccggcaatgccccatgccgcgcccataaacccgagcattttcgcccgtttttcatgcggataaatatcggcaacaatggtattcgtaaccggcatgatcgccccggccccgattccttgaatggcacggaacacaatcagctggcccatcgaaccggcaagcccgcacaacgtcgaaccggcaagaaaaacaacggtgccggctgtgaaaatttttttgcgaccgtacaaatccgcaagcttcccgaaaattggaaccgttactgctgaagtgagcaaataaatggcaaatacccagttcatcacgccgatccctttcaggtcgctcacaatccgcggcatcgcggtgctgacaatcgtcccctcaatggctgttaaaaaggtagccacaaacagggcgattgtgaccgtcttgacattggtttgtttcataaaaagtcctccatgatttgttcgttctgcactttttctagtatatatcaacttgccgcggaaaaatagatttctagactcaggaaagaatctgcataaaaagaaatcatttccccataataaagattgacatctgacacatcatgaatgataa
